(12) United States Patent
McBrine et al.

(10) Patent No.: US 10,174,294 B1
(45) Date of Patent: Jan. 8, 2019

(54) RECOMBINANT K2 BACTERIOPHAGES AND USES THEREOF

(71) Applicant: Charles Stark Draper Laboratory, Inc., Cambridge, MA (US)

(72) Inventors: Connor McBrine, Somerville, MA (US); Georgiana Kourepenos, Acton, MA (US); Jason Holder, Swampscott, MA (US)

(73) Assignee: THE CHARLES STARK DRAPER LABORATORY, INC., Cambridge, MA (US)

( * ) Notice: Subject to any disclaimer, the term of this patent is extended or adjusted under 35 U.S.C. 154(b) by 0 days.

(21) Appl. No.: 15/908,162

(22) Filed: Feb. 28, 2018

(51) Int. Cl.
| | |
|---|---|
| *C12Q 1/68* | (2018.01) |
| *C12N 15/00* | (2006.01) |
| *C07H 21/04* | (2006.01) |
| *C07H 21/02* | (2006.01) |
| *C12N 9/22* | (2006.01) |
| *C12N 7/00* | (2006.01) |
| *C12N 15/74* | (2006.01) |
| *C12Q 1/02* | (2006.01) |
| *C12Q 1/04* | (2006.01) |

(52) U.S. Cl.
CPC ............... *C12N 7/00* (2013.01); *C12N 15/74* (2013.01); *C12Q 1/025* (2013.01); *C12Q 1/04* (2013.01); *C12N 2795/00021* (2013.01); *C12N 2795/00043* (2013.01)

(58) Field of Classification Search
CPC .......... C12N 15/85; C12N 7/00; C12N 15/63; C07K 2317/76; C07K 2317/622
See application file for complete search history.

*Primary Examiner* — Barry A Chestnut
(74) *Attorney, Agent, or Firm* — Christopher J. McKenna; Foley & Lardner LLP

(57) ABSTRACT

The present disclosure provides compositions including recombinant K2 bacteriophages, methods for making the same, and uses thereof. The recombinant K2 bacteriophages disclosed herein are useful for the identification and/or antibiotic susceptibility profiling of specific bacterial strains/species present in a sample.

26 Claims, 90 Drawing Sheets

Specification includes a Sequence Listing.

Site A
Wild-type (WT): 991 bp
Recombinant: 1521 bp

Site B
Wild-type (WT): 989 bp
Recombinant: 1519 bp

Site A
Wild-type (WT): 991 bp
Recombinant: 1521 bp

Site B
Wild-type (WT): 989 bp
Recombinant: 1519 bp

Figure 9

K2 site A Donor: (SEQ ID NO:2)

**CTTAATATTCATGGTGGTGTTCATATGTGGGGTCGTGGTGGTAATGGTGGATACACTCACTCAGGAGGCGACGGTAA
CGGTACACAAGGCGGTCATGTTATTCAAAATGATATCGGTGGACGGCTTCGTATTTGGAACTACGGTGTTATAGCTG
CTGGCGGTGGCGGCGGTGGTGGTATTGCATATCGTCCACACTCAGGGGCAAACTGGCAAGATATCGGTGGCGGTGGT
GGTCGACCTTTCGGTGGCGCTGGCGGTGGCGGTTATTCCGGTGGTGCTGCTTCGTATGAAGGTCCGGGT**GGAGGATA
CGATTACGGTAACGCACACTCCGGCGCTGGTGGTAATGCTGGTGCTGCTGGTCAGAATGCATGGTCTGACGGCGGTA
AGTTCTTAAAGTTGGTGTTGGTGGTGCGTCTGGTCATGCAGTGTTTGGATCTTCTCCAACTTGGGGTGTTGTTGGA
ACAATTTACGGACCAAGAGTATAAAGAGGAGATATACAATGGTCTTCACACTCGAAGATTTCGTTGGGGACTGGCGA
CAGACAGCCGGCTACAACCTGGACCAAGTCCTTGAACAGGGAGGTGTGTCCAGTTTGTTTCAGAATCTCGGGGTGTC
CGTAACTCCGATCCAAAGGATTGTCCTGAGCGGTGAAAATGGGCTGAAGATCGACATCCATGTCATCATCCCGTATG
AAGGTCTGAGCGGCGACCAAATGGGCCAGATCGAAAAAATTTTTAAGGTGGTGTACCCTGTGGATGATCATCACTTT
AAGGTGATCCTGCACTATGGCACACTGGTAATCGACGGGGTTACGCCGAACATGATCGACTATTTCGGACGGCCGTA
TGAAGGCATCGCCGTGTTCGACGGCAAAAAGATCACTGTAACAGGGACCCTGTGGAACGGCAACAAAATTATCGACG
AGCGCCTGATCAACCCCGACGGCTCCCTGCTGTTCCGAGTAACCATCAACGGAGTGACCGGCTGGCGGCTGTGCGAA
CGCATTCTGGCGTAATGTGAATAAATACCCTTAAAAGGAGGGTCTATGGCAGCACCTAGAATATCATTTAGTCCAAG
CGACATCTT**GTTTGGTGTTCTAGATCGCTTGTTCAAAGATAACGCTACCGGGAAAGTTCTTGCTTCCCGGGTAGCTG
TCGTAATTCTTTTATTTATGATGGCGATTGTTTGGTATAGGGGAGATAGTTTCTTTGAGTACTATAAGCAATCAAAG
TATGAAACATACAGTGAAATTATTGAAAAGGAAAGAAATGCACGCTTTGAATCTGTCGCCCTGGAACAACTCCAGAT
AGTTCATATATCATCTGAGGCAGACTTTAGTGCGGTGTATTCTTTCCGCCCTAAAAACTTAAACTATTTTGTTGATA
T**

Figure 10

K2 site B Donor: (SEQ ID NO: 3)

**AATAATAGTCATTACCGAACATATCAAAACCCTTCCAACTCTCTACCACATATCGCTCAAAACTAATCATAATTAGG
CCTTTTTATCAAGAACAGCATTCAGTTTGTTAGTAATTTTATCCAGACGCTCATTGAACTCGCTAGAAGATAAGCCT
TTTTCTGGAGAAATTAAGCTAATCACGAAAAATATAGCAATAAAAGGAATAAGAAAAATAGCACCAACTGCCATAAA
CAAAAAGAACGTTACAGTTGTAAGAAAATCAGCTAAACCTTTACGAAATTTATACATATTTTACCCTTA**ATTCTAAG
ACCAGGCATTGATAAGCACTAAACTATATTGCGAATAAAATTCTGGACCAAAATGAAAAATCATATCATTTATAGTA
TCCATAATGTAATTCAATTTACGCCAGAATGCGTTCGCACAGCCGCCAGCCGGTCACTCCGTTGATGGTTACTCGGA
ACAGCAGGGAGCCGTCGGGGTTGATCAGGCGCTCGTCGATAATTTTGTTGCCGTTCCACAGGGTCCCTGTTACAGTG
ATCTTTTTGCCGTCGAACACGGCGATGCCTTCATACGGCCGTCCGAAATAGTCGATCATGTTCGGCGTAACCCCGTC
GATTACCAGTGTGCCATAGTGCAGGATCACCTTAAAGTGATGATCATCCACAGGGTACACCACCTTAAAAATTTTTT
CGATCTGGCCCATTTGGTCGCCGCTCAGACCTTCATACGGGATGATGACATGGATGTCGATCTTCAGCCCATTTTCA
CCGCTCAGGACAATCCTTTGGATCGGAGTTACGGACACCCCGAGATTCTGAAACAAACTGGACACACCTCCCTGTTC
AAGGACTTGGTCCAGGTTGTAGCCGGCTGTCTGTCGCCAGTCCCCAACGAAATCTTCGAGTGTGAAGACCATTGTAT
ATCTCCTCTTTAATCATGTTTCCACACTCCGTC**GGTATTTGACCAAAGTCGCTGATTATCTGATCCTCGCCACAGCT
TTTTGGTCGGAAGATTTTTCTCATACTTCCCATCAATAATAACATCAACATATTTAAGCATTTCTAGTTGTTTAATA
TCTTCAAACTTATATCCTGTCCACAACCAAATGCTTTTATTGGGATAAAGATTTTTAATAGTTTGAACCACAGAGTG
AATCACGTCTCTGTTATCAGGATAGAGAGGGTCACCTCCGGTTATAGTCAATCCTTCTATATAATCATTATTCAAAC
ATTCAATTAATTGTTCTAGTGTTTC**

Figure 11(A)

K2 double luciferase contig 1 (partial genome assembly) (SEQ ID NO: 4)

```
ATGTGTTTCCAGAAAATTTCTTCTTTAACTACATCATCTTTACGAGTATCGCCTTGTTTGCGTTGGATATGCAAATTAAACGGAATATCGTTTTGTA
AAAGCCACTCACGTGTCATAACATAATATTTTAACTTAGCATTTTCGGTGCCAGATTCACGTCCGCTTACAGTAATAATCTCATAACCCGAGTGATG
AAGCATCTTCAGATATTGTACAACCATTTCGTTTGGTGTATCGGTTGATAATTTATCTAATTCGTATGGGCCACGAGATGTATGAATAGCTAGTGTT
CCATCAAGGTCAAAGATTGCAGCTTTTGGTTTACCAGGAGTCCCTTTGTATACCGGAAGACCGAGATACTCTCGCATACTTTTATACATTGAGCGTA
AAACATCAATTGGTACTGCTTTAGTTCCACGTTTTGAGTTACGTTTAACCAATTCAGTCCAAGGAACATCAAACACTTTATATTCAACTTTCCATCC
GTATTCTTTGGCAAAAGTTTCCCATGCTAGGCGACGTTCAGGATTCAAGTTAGTGTCTGAAATAATTACTCCCTTGACAGAATCACCGCCGTACAGA
ATACTCTTCGCGGTATCAAACTGCATACCGGTCACAATGCCTTCTTTCTTTTTGGTATACTTGTACTCGTCACGTTCTTCATGACCCATGATGGATT
GACGATAATCATCACGATTGATATTATAAAATCCAGGATTTTTAGCAATAAATTCACGAGCCCAAGTGCTCTTACCTGAACCAGGACAGCCAATAGT
TAAAATAATCTTTTTCATCATTTAATTCCTAAGAAAACTTCAAGAATACGAATATTATGCTCACGTCGCTCTTTATACACTTCAGCTGTTGATTGAT
TCACTGATTTGCTCTGAACATTAGATGAAATAAATTTTATCATGTGATTTTTAAGCTGATACATATCAAGTCCACGAGCTTTTGCTTCTTTTCGTAG
AGCTTTACCAGCGTCATCTAAAGCTTTCGTAGGGTCTTCATCATTTAATACTATTCCACGATCCAAATCCATGTATACTGCACCATGACATGCATCA
ATGTAAAGGTCTGAGCATTCAATATAACGTTCTAACAGAGTTTTCATTTATTTTTCTCAACTAATGATTGAATATAATCATGCAGGTCTTTAGATGC
TTTACCCCACTTATTTTGATATTCATTTTTGAGATTAGCACGGGATTGAGCTAATAAAACATCATTAGTTGGAGGTAAAGATTCTAACCGCTGAATC
TGGCGTCCATAAATCATTGCAGCCATCTCGGATTCATAAATCAATCCTTTGAGATGTTCAAATTGATGCCATGAAATCATTTACATTTATCCTCTTT
TAACTCTTGACGATAATAACATATCATAGTTTTTGGTCATGTACATATCGTTTTACATCATTAAGCCAAATACGAAATTCCTGGGAATCTTCAAAT
GACATACCGACCCAAGCTTTACCATCAATAACTTTAACTTGCCAAGATAGTTTAGCTTCATCATATGACTTTATCTGTACAGGCCAATTAGGATGAA
CTGTTTCTTTCTTTACTTCTAGAGGCTTTGTCGAACAACCAACTAGAAGACCAATAGATAATATTACTGCTGATAGTTTAATCATTTAGAAAGGTCC
TGGATGTCTTCTGCGAACTTGTTGAAGGAGTTGTTGATTTGTTTTTCAACCAATCCTGGCTTACGAGCCACCACATCCGCCTTCTTTGCATCTTTGC
GCAGTTTTTCATTTTCACGCTCAATAGCAGCAATCGCCTCACGATTTTTATTATTCATCGCATCAATATAATTATACTGAATTCGCAAATTATTTAA
TGCTAAGGCGTTTTCATTGGCCGTTTTTGTAATTTCTACAACAGACGTTTCTAATCTTTCAATTTTATTTTTTAAAATTAAAGAAGTTCCGCCTAAT
GCAATTACAATTAATAGCAAACCTGCTGTCGTATTACTTAATTGCATAAAGTTTTAATAACCTCTATAATATCGTCTTGAGAAAGACCGTTAATTAA
AATATGATGTTCAGCCGGAGATTTAGAAATTTTAAAGCACGCCGCAACATCTTCTGCCATATCCGATGCGCTACGATTTGGATTACTAATTCCAAGA
CGATGTTTCCCGTTAAAGGATTAACGATGATATAGCATTTACAGTTGTTAATATGAACATTAGGTTGAGTCTGATTAATAAACACTTCACAATCAT
ACTTAGCGAGTTGATTTTCTAAAAAGACTTTCATCTCCTCAACCGCATCAGGAAGCATATCACGGGCTTGCTCAAGACGACGATTTCGATATTCTTT
AATGGTCGTTTCCGCTTGACTTGCTTAGCTAAATCTTTCTTAAGATCGGTGATATATCCAACTCGACGATTTCCTTTAAATACAGAAATCCCATCT
GTAGTATCACCGTATGCTTCAACGACCATTTCAGTAGTAATAAGCTGTAAATCCATCATAAAGTCCTCATGTTATGTCAGTAAGTCTACTATAACAC
AACACGAGGGGTTTGTAAACAGCTTAGTATCCTTCTGGGATAAATTTTTATAAATTTTTCAAAAAATTCTGTTCGATTTCACACATGACCTTTTCTT
GACTATCGTACCCCTGGTATAAGCTCATGATGATACCGAACAGATGTTCCATTCCAGCACCTTTAGCAACGCCTTGCGCTTCCATTGCATAAGTCTT
TCTATCCTTACCACAATGTTTATTGTGACAGTCAAGAACTAAAAACAGAGCTCGGTCTAAGTACTTCAGATAAGTCGTTTCAAACGCCTCAATTTTT
CTGTATGAATATTCATCATCAGCGTACATTGCTTTAAGATCATCTGATGCACCATCAATAATAGTCTTAAACAGTTTTTCTGGATTGTCTAATGAGC
TTTTTGTACTATGAAGAGACACGTACCAGTCAGACTTAATTTTAAAATGAGAACCATCTTTCATCACAGCAACATAGCCTTCGATGTTTTCCGCATT
TTTAGCTTCTTCTACCCATTTAGGGCTATCGATTTCGTATCGTTCAACTAGATATGCAGAAGAACAGCATCTTTATAAATGTCATCATATGAAATG
TATTCACCTGTTTCATTTTCACGAATATTCAATAAAATGATTTTCACCTCTTGATAAGCAAGAACGATTCTATTAGTTGGAGCGACGAATTCGAAGT
TAGCAGTAAATCCATCTTCAGCTAATTCTTTAAGTCTATCACGCAACCGATGGTGATTAATATTCATCAAAATACCATTAGCCATTAAAGCCTGTTC
GGATTTGATTGAACCCTTTGATTTGAACAGAATTTCATCACCATCTAAATAAGTTGATACCAAAGACCCATCTTCCTTTGTCAGAATGTAATCAACA
TCATTTAAATCGATATTCATCGTGAATGGATTTTCATTTAAGTTAAAAAACTTTTCCATAGGACGGAGAAGCAATTCTTACTGGTTTTTCTCCATCCA
TTTCAAACATGATTCCACGACATTCCAATGCATCTGGAAGTAACCAATCAGAATAAGATGCATAATTATATGAGAAAATTCTGTAAGTTCTTCCAGA
TGCACTTACATCATCTGAGTAAAAAAACTTACGCTGTGAATCCTTACATAGTTCCATTAAATTGTTAAAAAGTTCTTGCATTGTGTATCCTCTTTTG
TGTTTTGAATATAGTACCACACTCCATGTGGAAGCATCATTTTTTCTTATGTTGAATATTCCAAGGCGGGTTAAACAGCTTAATGAATAGTGGTTCC
TCTAGGTCAATCGTCGCGATTGTCATTGTACCTAACTCATTTGTCATAGAAAGATTAAAACATTGGCGGGCGTAAAATTCAACTTTGCTTCCTTCCT
TTAGCGCAGAATGAATTAATGCAGATTTAGTAGAATCAGACGTTTTGTCTTTACGATTAATAGCAGTTCTATAATAGTTTATTCTTTTACGTAAATT
TTTAGTTTTTCCAATATAAACAAGCTCATCATTTATAGCAATAGCATAAATTACGTTATACTTGTTTGGAATAGATAATTGTTTTATACTTCCGTTG
TCGTCTAATTCTAGCTCAGTATATTTAATAAATGAATATTCGTTGCAATTTCTTTCATAATAAAATGGGCCTTGCGGCCCACTCCTTAAAAGTATT
TTTTAAAACTCATCATAACTTTATCATCAACATCATTATCAATCTGTGCAACAAGATAAGATGACAGTTCTACTTCTTGCGGCGCGGATTGAACATT
ATCAGAATTAAGGTATTCACGAATCCAAGGATATGGATGTTTAACCGGAGCACCGGTAATTGGGCATGGAAGACCACACTGTTTCATACGAGATACA
GTTAAGTAATCAATAAAGCTCCACATGCTATTTGTATTTAATCCAGGAACATCGCCATCTTTAAATAAATGAACTGCCCAATCTTTTTCTTGGCGGT
TAACTTCCATGAAAATATCAACTGCTTCTTGNTCNCACTCTTTGGCAATTTTAACCCATTCATCACCATCAGTGCCAAGTTGAAGTTGACGAATAAT
ATATTGTGTACCTTTAAGGTGGAGTTGCTCATCACGCGCAATAAATTTCATAATCTTCGCGTTACCTTCCATGATTTCCATATTCTTATGGAAGTTG
AAAGTACATGCAAAAGATACATAAAAACGGATAGCTTCCAGGGCATTGATAACGTGCAAGCAGAGATAAAGCGACTTCATCAGGTCACGTTTACAAC
CTGCAACATGGTCAATAGCGTCTTGGACAAGTTCTTCATCATGCTCTGTTGCCAGGTAGAATTCTACGTCAGCTTTAGCGTTTTCCCATTCACGAGT
CTTTACCAGAACATCATCATAATAACGACCAATCGATTCAGCACGTTTCATGATTGCATCATCAAGAATAATCTCATCAAATACCTTGGCAGGGTCA
TTGAACAGGTTACGCATGATGTGAGTATAAGAACGTGAGTGAATAGTTTCACTGAATGTCCAAGTTGCAGTCCATGTATCTAATGACGGGTCAGAAA
TCAATGGCATCAGTACTGCTGCAGGAGCACGTCCTTGAATACTATCTAACAATGACTGATATTTCAGGTTGTTAGTAAAAATATTTTGCTGATACTG
AGGAAGCTTATTAAACTGTGCAGCATCCATCATCAAGTTTACTTCTTCAGGACGCCAGAAAAATGATAATTGCTTTTCGGTTAAATCTTCAAAAACT
TTATGACGTTGAATATCATAACGTGCAATACCAAGACCTGAACCAAAAAACATAGGTTCTTTTAAAACATCAACTGGATTTGTATTAAAAACTGTGC
TCATAAATTTTCCACTTAGTTAATAGTTGGTGACTCGTCCATGAGTCAAATTATATCATAATTTACAGGATGAACAATCTTCAGCTTTTGGAGTTTC
TATTTCATAATCATCAGTACCAGAACCGTCACGGGTATTATGATAATAGAAATTTTTTCCGCCAAAATACCAGAAATACAAAAGGTCATCAATCATT
ATTGACATTGGAACCTTGCCTTTAGGGAAGATTTGGGGGTCATAGTATGTATTCGCTGAAGCTGATTGACATACCCATTTCAGCATAATAGCTACCT
GCGTAAGATAAGGTTTATTACCTTTCTTAGCTAATTTCCATGTATAATCATATAAGTCTATGTTATGTTCAATATTGGGCACGACTTGATTAAAGGA
ACCCTCTTTTGATTCTTTAACAGAGACTGGTCCACGTGGAGGCTCGATACCGTTTGTACTGTTAGAAACTTGGGAAGATGACTCACATGGCATAAGT
GCTGATAGTGTGCTATTACGGATGCCAAAGAGCTTAAGGTCTTCCCGCAGCGACGACCAGTCACAAACGTATTTTGGAGCTGCGATTTGGTCAATCT
```

Figure 11(B)

```
TTTTATTGTACCAGTCGATAGGTAATTCGCCTCGAGACCAACGAGTGTCTGAATAATATTCACAAGGTCCTTTTTCTTTGGCGAGCTTAATGGATGC
TTTAATGAGTCCATACTGTAATCTCTCAAATAGTTCATGTGTTAAATCGTTAGCATCTTCATAAGAAGCAAAGTTACTTGCCAACCAAGCTGCATAG
TTAGTAACACCTACGCCGAGGTTACGACGCTTTTTAGCTTTTTCTGCTTCAGGAACTGGATATCCTTGGTAATCCAAAAGATTATCAAGAGCACGAA
CCTGGACTTCTGCCAATTCATTAATTTTATCTTGGTCTTGCCAGTCAAAATTATCCAGTACGAATGCAGAGAGAGTACACAATCCAATTTCAGCATC
AGGACTATTCACATCATTTGTTGGAATAGCAATTTCACAGCACAAGTTACTCTGACGAATAGATGCCTTTTCACGAATAAACGGAGTATAGTTATTC
GTATTATCAATGAACTGCACATAAATCCTTGCTGTTCCTGAACGTTCAGTCATGAGCAATTCAAATAGTTCACGGGCTTTAATACGCTTTTTACGAA
TATTAGGGTCTTTTTCTGCTGCTTCGTATAATTCACGGAAACGGTCTTGGTCTTTAAAATAAGAATAATACAGCTCTCCACCCATTTCATGCGGACT
GAACAAAGTAATGTAATCGTTCTTTCCGAATCGTTCCATCATCAAATCATTCAGCTGAACACCATAATCCATATGACGAATGCGGTTTCTTCTACG
CCTTTGTTATTTTCAAAACGAGAAGATTTTCAACTTCCAAATGCCAAATAGGATAATAAGCAGTAGCAGCGCCGCCACGAATTCCACCCTGTGAGC
ATGATTTAACAGCAGTCTGAAAATGTTTCCAAAAAGGAATAACACCAGTATGGCGTACTTCACCCATGCCAATCTTAGAACCTTCAGCACGAATCAT
ACCAACGTTAATACCAATTCCAGCGCGTTTAGAGATATATTCAACAATTGAAGCGGAAGCCTTATTGATAGACTTCAATGAATCTCCTGCCTCAATA
ACAACGCATGAACTGAACTGTCGAGTCGGAGTACGGCAACCAGCCATAATAGGAGTTGGCAGTGAAATCTGTCGAGTAGATACTGCTTCATAAAAAC
GAATAACATGTTTTAATCTATCAACAGGTTCATCTTGATGCAATGCCATTCCAATAGTCATAAATGCAAACTGTGGAGTTTCATAAATTTGACCAGT
GGTTTTATCTTTAACTAGATATTTTTCTTTTAATTGCATCGCCCCGGAATAAGTAAATTCCATATCCCGTTCGTGCTTAATTTTTGATTCTAAAAAT
GTAAATTTCTTCTGCTGAATATTTTGACAATAATTCGGGGTCATATTTACCTTCATTTACACAGTAAGAAATATGGTCAATAAATGAACGTGGTTCAT
ATTGCCCGTAAACATGCTTACGAAGAGCAAACATTAAACAGCGTGCAGCTACGTATTGATAATCAGGCTCTTCAACTGAAATAGAATTCGCAGCAGC
CTTAATGACAATAGTCTGAATGTCATCAGTGGTCATTCCATCACGGAGATATGATTTAATATTTTCATATAATTCATAAGGATCTACAGATGTTCCT
TCAGCTGCCCAAGATAAAACTTTAATAATTTTTTGTGGATCAAAGCTCTGAGAAACACCACTACTTTTGATAACATTAATTAATTGCATAAGTCCTC
AACTTGAAAATCGTCTTTAAACAATCGGTTAACTATATGAGCTATTATATCACCATGACACGGCTTTGGTTTACATGTGCATCCTAGCCTCATTCCA
CGTAAAGGCTCTAAATGTGCTTTAGTTATTTCTCCGGATTTAATTCGACGTATAAAATCTTTTTTGAATAATTCAATGGCAGCCTCCCGGCTGCCAG
CATCTTTACCGACGTAATTTCCCCAAAATGTACCACGGTGAATATTAACATCAAAGTCGGATTTGTATTTATTCACTACCCGACATAGACGGCCCGC
GCGGTGATAATTCGGCATATTGTTTTTCCGTTAAAACAGTAATATCGTAGTAACAGTCAGAAGAAGTTTTAACTGTGGAAATTTTATTATCAAAATA
CTCACGGAGTCATTTTATGAGTATAATATTTTTTGCCATAAATGATAATAGGCTGATTTGGTCCTGGAACTTCTAGCTCACTTGGATTAGGAAGTGTA
AAAAGAACGACACCAGAAGTATCTTTAAATCGTAAAATCATATATCCTCGCAATTAAATTAAAATTATACCGCCATTTTTCCTTTCAAGACACCGTG
GGACTGATAATCTTTGAGAACGAAATCTTTAGGCCTGAGTTTAAGAATATATTCCAATTGTTCTTTAGTAGAAAAGATAACGGAATTTATAAGGCAAT
CCGCCTATTACCAGTTCACAAAGCTCTTTAGGTTCACGACGTAAAATTTCTTTACATTGTTCTACGTGATTCATATAGATATGAGTATTACCGCCAG
AAAAATATCAAATCTCCAGGAATAAGATTACACATCTTAGCTACAATATGAACTAACGTAGCATATGATGCAATATTAAATGGAAGCATTATGTTCAG
ATAAGGTCGTTAATCTTACCCCGGAATTATATCCAGCTGCATGTCACCATGCAGATCAGACTATATCTCCAACTTGTTAAAGCAAGTTGTCTATCGT
TTCGAGTCACTTGACCCTACTCCCCAAAGGGATAGTCGTTAGGCATTTATGTAGAACCAATTCCATTTATCAGATTTTACACGATAAGTAACTAATC
CAGACGAAATTTTAAAATGTCTAGCTGCATCTGCTGCAAATAACCCCATCACATGAAATCTTTTAATATTACTAGGCTTTTTACCTTT
CATCTTTTCTGATATTTTAGATTTAGTTATGTCTGAATGCTTATGATTAAAGAATGAATTATTTTCACCTGAACGATTTCTGCATTTACTACAAGTA
TAAGCAGAAGTTTGTATGCGAACACCGCACTTACAAAACTTATGGGTTTCTGGATTCCAACGCCCGTTTTTACTTCCGGGTTTACTGTAAAGAGCTT
TCCGACCATCAGGTCCAAGTTTAAGCATCTTAGCTTTAACAGTTTCAGAACGTTTCTTAATAATTTCTTCTTTTAATGGATGCGTAGAACATGTATC
ACCAAACGTTGCGTCAGCAATATTGTATCCATTAATTTTAGAATTAAGCTCTTTAATCCAAAAATTTTCTCGTTCAATAATCAAATCTTTCTCATAT
GGAATTTCTTCCAAAATAGAACATTCAAACACATTACCATGTTTGTTAAAAGACCTCTGAAGCTTTATAGAAGAATGGCATCCTTTTTCTAAATCTT
TAAAATGCCTCTTCCATCTCTTTTCAAAATCTTTAGCACTTCCTACATATACTTTATTGTTTAAAGTATTTTTAATCTGATAAATTCCGCTTTTCAT
AAATACCTCTTTAAATATAGAAGTATTTATTAAAGGGCAGTCCTACAATTTAGCACGGGATTGTCTACTAGAGAGGTTCCCGTTTAGATAGATTAC
AAGTATAAGTCACCTTATACTCAGGCCTCAATTAACCCAAGAAAACATCTACTGATCGTTGATACCACTGCAAATCCAAATAGCCATTACGCACATT
AAACTGATAGAACATATGACAAGGCGGTAATGCCATATATTTAAGTTCAGCTGGATTCCATGCTGAAACAATTTGACGCCTATCATTTGGCAGTTTT
TTAATACGATCAATAACTTCTATAATTTGGTCTACACCACCAAAATCACGCCACTGTTTCCATAAATTGGACCAAGTTCACCGCTATGGTATCCTA
AATCTTTTGCTTGATTTTCGTAATTTTCATCCCAAACTGTTTTGCCTTGGATTAACGAATCATGTTGAATTAATCGCAAATCATTGACATTTGTGCT
TCCCGATAAAAACCATATTAGCTCAGCAATGCAAGCTTTCCAGGCGAGCTTCTTAGTTGTTACTGCAGGAAAACCTTTAGTTAAATCCCAGCGTAAT
TTAGTACCGAACAAAGCAATTGTTCCTGTGCCTGTTCGGTCATCGGTTTTGTAGCCATTTTCCAGGATATCTTTAATTAAAAATTGGTATTGTTTCA
TTAGTTCATCCAAGAATATGTAGAAGGATATTTGGCAAAGTTAGGCTTATATCCTAATTTAACCATTTGTTTTGCTTTGCGAGTAAATCCTAAAGAA
CGCTCACCTTTAAGATATTGTTTTGGTGTCATAGGCCCTTGATGCATCTGCCTACAAATAAAAAGGGCCATAGCATTAGGAACATCCTTAACTTTTA
ATTTATTGCTCATTTATATACTGATTCCGTAAGGGTTGTTACTTCATCTATTTTATACCAATGCGTTTCAACCATTTCACGCTTGCTTATATCATCA
AGAAAACTTGCGTCTAATTGAACCGTTGAATTAACACGATGCCTTTTAACGATGCGAGAAACAACTACTTCATCTGCATAAGGTAACGCAGCATATA
ACAGAGCAGGCCCGCCAATTACACTTACTTTAGAATTCTGGTCAAGCATAGTCTCGAATGGTACATTAGGGCTTGACACTTGAATTTCGCCGCCAGA
AATGTAAGTTATATATTGCTCCCAAGTAATATAGAAATGTGCTAAATCGCCGTCTTTAGTTACAGGATAATCACGCTCAAGGTCACACACCACAATA
TGGCTACGACCGGGAAGTAATGTAGATAATGACTGGAACGTTTTAGCACCCATAATCATAATTGTACCTTCGGTACGAGCTTTAAAATTCTGGAGGT
CCTTTTTAATTCGTCCCATGGTAAACCATCACCTAAACCGAATGCTAATTCATTAAAGCCTTCGACCGTTTTAGTTGGAGAATAAGCGAATACCAA
TTTAATCATTACGCAAAACCCCTTTCAATAAACCATTCAGTGGCTTTATTAGCATCAAAGAATAATTCTTCATACGTCTTTTCTTTGTTTTCAAAAA
CTGTCACACAAACACGTTGACATTCTCCACAGTATTCTTCTGACATGCTCAAAGCGTCAGAAAACATTTCGTTAAATTCACTTAAATCAGGATTATG
CAATGCGTTAAAAATTGCATAATCGAATTCATCATTCATAAATTCAAATACAAAAATCATATTACCTCCCACTCGAAAGGGGCCAGAAGCAAATCCGC
TATCTTTAATCATTTTAACTAAAGTTACCATTCCTTTGTTAACTGCTTGTGCGATTTCATCAAAAACTTCATCGCTATCATCATAAAGGTCATTAAA
AAGTTCTAACACGTTCTTCTGAACTTTTAATTTATGACCAACAATCTCGCCTACAGTAAATTCGTTTCCGCCGATTCCAGTGTAAAACGTAATTACA
CCAGTTAACAGACTTTCGCGAGAATCTAGGTCATGTGATAAATTAATATAAGCCATCCCGGGTGCAGTTTAAGTTGGCAACGAATTCTTACTTGGG
TAATTCCGGTTACATGAATGACGGACATATTATTTTTCCTCAAATAGACTTTTTCACAATTTTCCAATCAGCTTTAAACTGATCAACGTCAGAATGAT
AAATCCAGAATCCTGCGCTTTCTCCATCCTCATAAAGAGGGCATCTATCACATTCATCTTCCCATCCCATATCACGCAAAAGATGTTCAGCTTTTTC
AACAAGCCCAGAATCTTTACCGATGATATTAAAATACCATTTACCTTTAACTTCTGAATCTTTGATGCTCTGGCGTTGTAATCTCATTTTATTCTCC
TTAGCAAGCTTTAATCAAAAGATATAAACAGACCAACATAACTGCTGCCATAATATAAGGTGCGAACATTTTCTTTTCTCCATTAGTTTTGATAGGG
TAATAGTATTATCACACTACTACCCTGTTGTAAACTACTTTTTGAAAGTTTTTCGCAAAAGTTCAATGATTTCATCTACATTATTTTCGTCAACAAT
GCAGTGAATTTTTGTTACGCCAGAAACCTTGTCTTTAACTTCATCCTCTTCAGAAGTAGGTTCTTTATATTCGTGGAAACAATGAAATTCGTCTTCA
CAAACGTTAAAGTAAAAATGCTTTCCATTTGCGCATTCAATGTGTTTTATTACTCTAAATCCATCAACAAAGAAAGCTTCTTTAACTTCAAACCATC
CACCATTTTCTTGAATAATTTTAACTATTGATGAATTAGAACGTGGGCGATAATTAATAAATGTATCAATAAGTCTTGGAACAAGCTCATACTTTTT
GCCAATATACATTACGTTTTCCTCATTTTAACGGGGCTTGTAATAGCCCCTTGATAATTATTGTTCAATCAATCCCATGTAAAATTCTGCGTCTTCA
```

```
TCAGTTTCAGCAAATAGTACATTAACTATTTCTAATACTGGAACGGCAACTCGTCTGATTTTTGAGAAAGGACCTCAAACTGGAACAAACCCGGCTC
AAACGATGACAGTCAGAGTGTGGGGAAATCAATTTAGCGGGGAATCAGACACAACACGTTCTACCGTATTTGAAGTTAGTGATGAAACGTCTAGTCA
TTTTTATTCTCAGCGTAATAAAGCTGGAAATATAACATTTAATATCAACGGTACAGTAACACCGATAAATGTTAATGCTTCAGGAACATTGAATGCA
AATGGTGTAGCAACATTTGGTAATTCAGTCACTGCAACTGGTGAAATTATTTCTCGAAGCGCAAATGCTTTCCGTGCTATTAACGGAAATTATGGTT
TCATTGTTCGCAATGATGGATCAGTAACGAATTTTATGCTTACTACATCGGGTGATCAGACTGGTGGATTTAATGGATTACGTCCATTGTCCATTAA
TAATCAATCTGGGCAGGTCACAATTGGTGAAAGCTTGATCATTGCTAAAGGTGCTACTATAAATTCAGGTGGTTTAACTGTTAACTCGAGAATTCGT
TCTCAGGGCACTAAAACATCTGATTTATACACCCGCGCTCCAACATCTGATACTGTAGGATTCTGGTCAATCGATATTAATGATTCAGCCACTTATA
ACCAGTTCCCGGGGTATTTTAAAATGGTTGAAAAAACTAATGAAGTGACTGGACTTCCATACTTAGAACGTGGTGAAGAAGTTAAATCTCCTGGTAC
ATTGACTCAGTTTGGTAACACACTTGATTCACTTTACCAAGATTGGATTACTTATCCAACGACCCCAGAAGCACGTACCACTCGCTGGACACGTACA
TGGCAGAAAACCAAAAACTCTTGGTCAAGTTTTGTTCAGGTATTTGACGGAGGTAACCCTCCTCAACCTTCAGATATAGGAGCGATCCCATCTGATA
ATGGAATAATAGGTAATCTTACTATTCGCGATTTCTTGCGAATTGGTAATGTTCGCATTATTCCTGACCCAGTGAATAAAACTGTTAAATTTGAGTG
GATTGAATAAGAGGTATTATGGAAAAATTTATGGCAGAGTTTGGACAAGGATATGTCCAAACGCCATTTTTATCGGAAAGCAATTCAGTAAGATATA
AAATAAGCATAGCGGGTTCTTGCCCGCTTTCTACTGCGGGACCATATGTTAAATTTCAGGATAATCCCGTTGGAAATCAAACATTTAGCGCAGGTCT
TCATTTAAGAGTTTTTGACCCTTCTACGGGAGCATTAGTTGATAGCAAGTCATATGCTTTTTCTGCTTCAAACAATACAACATCTGCCGCTTTGTC
AGTTTCATGAATTCTTTGTCAAACAATAGACTTGTTGCTATATTAACTAGCGGAAAGGTTAATTTTCCTCCTGAAGTGGTATCTTGGTTAAGGGGAG
CAGGAACTTCAGTTTTTCCATCAGATTCAGTATTGTCAAGATTTGACGTGTCATATGCTGCTTTTTATACTTCTTCTAAAAGAGCTATTGCATTAGA
GCATGTTAAACTAAGTAATAGAAAAAGCACAGATGATTATCAAACTATTTTAGATGTTGTATTTGATAGTTTAGAAGACGTCGGAGCTACAGGATTT
CCTAAAAGAACATATGAAAGTGTCGAGCAATTTATGTCTGCGGTTGGAGGAACTAATAATGAAATTGCGCGATTGCCAACTTCAGCTGCTATAAGTA
AACTTTCTGACTACAATTTAATTCCTGGTGATGTTCTTTATCTTAAAGCACAACTATATGCTGATGCTGATTTACTTGATCTTGGAACTACAAATAT
ATCTATTCGTTTTTATGATGCATCAAATGGATATATTTCCTCGACCCAAGCTGAGTTTACTGGGCAAGCTGGGTCTTGGGAATTAAAAGAAGATTAT
GTAGTTGTTCCTGAAAATGCAGTAGGATTTACGATATATGCACAAAGAACTGCCCAAGCAGGTCAAGGCGGCATGAGAAATTTAAGCTTTTCTGAAG
TATCAAGAAATGGCGGCATTTCAAAACCTGCCGAATTTGGCGTCAACGGTATTCGCGGTTAATTATGTCTGCGAATCGGCTTCACCTCCAGATATAAT
GGTACTTCCTACACAAGCCTCTTCTAAAACTGGCAAAGTGTTTGGGCAAGAATTTAGAGAAGTTTAAACTGAGGGAGCCTTCGGGGTTCCCTTTTCT
TTATAAATAATATTTAAAATAAAGGGGCATATAATGGCTGATTTAAAAGTAGGTTCAACTGTAGGTGGATCTGTCATTTGGCATCAAGGAAATTTTCC
ATTGAATTCAGCCGGTGACGATGTACTCTACAAATCATTTAAAATATATTCAGAATATAATAAACCACAGGCAGCTGATAACGATTTCGTTTCTAAA
GCTAATGGTGGTTACTTACACCGGTCCAATTACTATTAATTAAGTAAGTTTATCTTCAATTAAGTAATAATGAAACCCCCATTCGAATTCGTT
CTGGTGGCGGTACCGGTAATACTCTTGTAGTTGGCGGCTCTTCCGGCGGTATTAGTTTTAGACCTGCAGGTAGTGAAATCACTACTGGACAAATTAC
TATTACACCAGAAGGTTTGACAACATTTACCAGGGCTGTAACGGCTCCATCGATAACTGTTACATCTACTCCTTCCGCAGCATCTGATGTTACTCGT
AAAGATTATGTTGATGGAGCAATAAATACTGTTACAGCAAATGCAAACTCTAGGGTATTACGCTCTGGAGACACTATGACAGGAAATTTAACTGCGC
CAAACCTTTTTTCACAGAATCCTGCATCTCAACCTTCACACGTTCCACGATTTGACCAAATCGTAATTAAGGATTCTGTTCAAGATTTCGGCTATTA
TTAAGAGGACTTATGCTACTTTAAAACAAATACAATTTAAAAGAAGCAAAACTGCAGGTCAACGTCCTGCTGCTTCAGTATTAGCCGAAGGTGAAT
TGGCTATTAATTTAAAAGATAAAACAATTTTCACAAAAGATGACTCAGGCAATGTTATAGAATTAGGTTTAAAATATGGAGGAACTATAAATGGATC
TTTAGAGGTTACAGAAAATATAACTGGAACTTTAATTGGAAATTCTAGTACAGCTACTAAATTGCAAACACCTAGGAAAATTAATGGTATATCTTTT
GATGGATCAAAGGACATTACACTAACTCCATCTGATATAAATGTAAATAGTACAACATTTATAAAAAATAACGGCGAATTACCCGTTGATGCTAATT
TAGATACATACGGGCCCATTGAAGAATATCTTGGTGTTTGGTCGAAATCTACTTCAACAAATGCGCAACCAGCAAATAAATTCCCAGAAGAAAATGC
CGTAGGTGTACTAGAAGTATTTGTGGCCGGCCAATTTGCTGGCACTCAGCGTTATACTGTAAGATCTGGTAACGTCTATATTCGTTCCTTATCTGCT
AAATGGAATGGCCGTCGATGGTCCATGGGGTGTGTGGCGTAATGTTCAAGCGTCAACTCGTCCACTTTCACAAACGATTGACCTTGATAGCTTGGGAG
AATTAGAACATTGTGGCTTATGGAGAAACAGTTCAAGAGCAATCGCATCATTTGATCGCCATTATCCAGAAGAAGGATCAGCCGCACAAGGATTTTT
AGAAATATTTGAAGGTGGTTTATACACAAGAACGCAGCGTTATACTACCCGCATGGGTATGGTTTATACTCGTTGTCTCGCTGCTGCATGGGATGCT
AGTGCACCTAAGTGGGAGGAATGGAAGCAGGTTTGGTCATGGCACGAGCGGACTTTCTATGATGGAGATCTGAATGATTTTTAAAACTCCTGGGTTAT
ATAATATTTTAGGCACTGATGCCGTTATTAACTGTCCTACCGGTGAAGGTTTGCCGACTGTTATTGTTGGTTTGCTGGAAGTTAAACAACGTGCTTC
TGGCCGGTGCTATTTTCCAAAAATTTACTACTGCCGGAACGGGTGCAACTACTCGCGATCGTATTTTGAGCGTGCATATACTGGTGGTGTGTGGGGT
ACATGGAACGAAGTATATACATCTTACTCTTTGCCAATTACTTTGGGTATGGGTGGTATTAAAGCCCAATTAGCGGAGCTAGATTGGCAAACATTTG
ATTTTGTTCCTGGTAGTATGTTTAGCGTTCCTTTGAACAAAATAAAGAACATGCCAGCAAATATGAATTGGGGTACAATTGACGGAAACTTAGTTAT
GTTTTCTGTCGGTCCTAGCGAACACACCAGCACAGGACGTACTGTTCAGGTTTGGCGTGGTACTGTATCCAAGACAAACTACCGTTATTTTGTCGTT
CGTGTGTTCGGTAATTCTGGAAATAGAACTTGCACAGTTCGCCGTGTTGTTCTTGAAGACGGATCACATACTTGGACTGCTCAACAAGATTTAATG
GTGCTGTTAACTTTGGTAGTTCAACAACGTTTAAATCAACTACAACATTTAATACAGAAGTTAAATTTCGCTCATTGAATGCATTCCGTATGTATGG
CGGAAAATTTGGTACATTTTTACGTAATGATGGAGAGAGTCTTTATATTCTTTCCACCGACGAAGATGATCAAGATGGAAACTTTAATACAAATAGA
CCTTTCCGTTATGAATTAAGACTGGTTAACTTTGGGTGGTTCTAGTGGTTCTAACGTGATTTTAAAATTAAAACGTGATTCTCTCACCGCATTTT
TTGGCCGGTGATATTAACATTAAAGGCACGATGACTTTTGACGCCGGACGTTTAGGATCACGAGATTATTTTAAATTTAACCATTGGGGTGATAGTAA
TAATGCGCGTGATAATATCATCCAGTTAGAAGACAGCAAAGGCGCTCATTTTTCCACTGAACGTACTTTAGCGACTGGTGCAATTAAGACTAAATTT
TTTGGTGAAATTGAATCCGATGGTAAATTGGTTATTAAACGTCCGGGTGATTCTATTGTATTATCAACAACTGCTAGTAATTCTTTGCATATTCGCG
GTGATATAGACCGGACTGGTAACTGGTATATTGGTAAAGGTGGTGCTAACGTTCTATAGTTATGCTACTAATGCTGGTGTATACAT
TACAAACGGAGGGATATCGCGCTAAGTCCAAAGGGTGCCGAAATGGCTCAGGTCAATAACGTTCGATTATATGTTCATGGTGAACGTTGGACTGCT
AGTCAACCAGGTGATTGGGGTCGTCAGTGGCAAGTGGAAGCGCCAATATTCGTCGATCATGGTTATGTTGGACCAGATAGCTATTATCAATTATTA
AAGGAAGAAGTGTAATCACCAATCAAGGGTTTGTAACTGCCGTCGATCTTGGTATTCGTCGTGTCAATAACAATTGGGGACAAGCAATTATTCGTGT
TGGATCTGCGGAGGCATCGCCAGCGGCTGGACACCCTAACGCGATATTTGAATTTCATTACGACGGTACTTTCTATTCTCCTGGTAATGGTAACTTT
AACGATGTGTATATTCGTTCCGATGGTCACTTAAGATCAATAAAGAAGAGAGTTAGAAAACGGACACTTGAAAAAGTATGCCGACTGAAAGTTTATA
CATACGATAAGGTTAAGTCTATTAAAGATCGTAGTGTTATTAAACGTGAAGTTGGTATTATTGCTCAGGATCTTGAAAAAGAATTATCAGAAGCTGT
ATCTAAAGTTGAAGTTGATGGATCTGATGTTCTGACAATTTCTAACTCCGCTGTAAATGCTCTTTTAATTAAGGCTATCCAAGAAATGAGCGAAGAA
ATTAAAGAATTAAAAACGCCTTTCTTCACTAAAATTGCTCGCAAAATTAGTAATTATTTTAAATTCTAACAACAAGGGCTTTGCCCCTTTGGAGAA
AATTATGGCAGTAGTTGTGTTCCCGGTTGGATTGGAAGTTCATCCGTAAATGAAACAGGACAACGATGGATGAGTCAAGCAGCTGGTCAATTAAGA
TTGGGTGTTCCTTGCTGGATGAGCCAATTCGCCGGACGCTCAAGAGAGATTATTCATACTGTAAGTGCTAATCATAATTTTAATGGTCAGTGGTTCC
GTGATAGATGCTTTGAAGCTGGCGGTGCACCCATTGTATTCAATATTGTTGGTGATATCGTTTCTTATTCTAAAGATGTTCCTTTATTCTTCATGTA
CGGGGATACGCCTAATGAATATGTTGTTCTTAATATTCATGGTGGTGTTCATATGTGGGGGTCGTGGTGGTAATGGTGGATACACTCACTCAGGAGGC
GACGGTAACGGTACACAAGGCGGTCATGTTATTCAAAATGATATCGGTGGACGGCTTCGTATTTGGAACTACGGTGTTATAGCTGCTGGCGGTGGCG
```

Figure 11(E)

```
GCGGTGGTGGTATTGCATATCGTCCACACTCAGGGGCAAACTGGCAAGATATCGGTGGCGGTGGTGGTCGACCTTTCGGTGGCGCTGGCGGTGGCGG
TTATTCCGGTGGTGCTGCTTCGTATGAAGGTCCGGGTGGAGGATACGATTACGGTAACGCACACTCCGGCGCTGGTGGTAATGCTGGTGCTGCTGGT
CAGAATGCATGGTCTGACGGCGGTAAAGTTCTTAAAGTTGGTGTTGGTGGTGCGTCTGGTCATGCAGTGTTTGGATCTTCTCCAACTTGGGGTGTTG
TTGGAACAATTTACGGACCAAGAGTATAAAGAGGAGATATACAATGGTCTTCACACTCGAAGATTTCGTTGGGGACTGGCGACAGACAGCCGGCTAC
AACCTGGACCAAGTCCTTGAACAGGGAGGTGTGTCCAGTTTGTTTCAGAATCTCGGGGTGTCCGTAACTCCGATCCAAAGGATTGTCCTGAGCGGTG
AAAATGGGCTGAAGATCGACATCCATGTCATCATCCCGTATGAAGGTCTGAGCGGCGACCAAATGGGCCAGATCGAAAAAATTTTTAAGGTGGTGTA
CCCTGTGGATGATCATCACTTTAAGGTGATCCTGCACTATGGCACACTGGTCTAATCGACGGGGTTACGCCGAACATGATCGACTATTTCGGACGGCCG
TATGAAGGCATCGCCGTGTTCGACGGCAAAAAGATCACTGTAACAGGGACCCTGTGGAACGGCAACAAAATTATCGACGAGCGCCTGATCAACCCCG
ACGGCTCCCTGCTGTTCCGAGTAACCATCAACGGAGTGACCGGCTGGCGGCTGTGCGAACGCATTCTGGCGTAATGTGAATAAATACCCTTAAAAGG
AGGGTCTATGGCAGCACCTAGAATATCATTTAGTCCAAGCGACATCTTGTTTGGTGTTCTAGATCGCTTGTTCAAAGATAACGCTACCGGGAAAGTT
CTTGCTTCCCGGGTAGCTGTCGTAATTCTTTTATTTATGATGGCGATTGTTTGGTATAGGGGAGATAGTTTCTTTGAGTACTATAAGCAATCAAAGT
ATGAAACATACAGTGAAATTATTGAAAAGGAAAGAAATGCACGCTTTGAATCTGTCGCCCTGGAACAACTCCAGATAGTTCATATATCATCTGAGGC
AGACTTTAGTGCGGTGTATTCTTTCCGCCCTAAAAACTTAAACTATTTTGTTGATATTATAGCATATGAAGGAAAATTACCTTCAACAATAAGTGAA
AAATCACTTGGAGGATATCCTGTTGATAAAACTATGGATGAATATACAGTTCATTTAAATGGACGTCATTATTATTCCGACTCAAAATTTGCTTTTT
TACCAACTAAAAAGCCTACTCCCGAAATAAACTACATGTACAGTTGTCCATATTTTAATTTGGATAATATCTATGCTGGAACGATAACCATGTATTG
GTATAGAAATGATCATATAAGTAATGACCGCCTTGAATCAAATATGTGCTCAGGCGGCCAGAATATTAGGAAGGGCTAAATAATTATTTGTTCGTATA
CATTTCTAGATATCGTATACACCCTCAAAACCCTCGTTGAATTCATCGATGAGGGTTTTCTTATCTTCTTGAGTTAATTCAGAAACAATTTTACGA
AATGAATTCTGATTTAACTTTCTACCTTCATGCGTTACTCCAATCTCATTAAGAAATGCAATAAAATTAGCACGATTCTCAACAATATCTTCTCTGG
AAAATTTAATCAAAATAGATGCAACAGTAATAATTTCACGAACTGTATCAATGTTTTTATTCATTAACTATACCACTCAATTAGTTGACTTTGTTAT
AATATCATCAGACGCTTGATTTGTAAACTGGTCTGTGTTATTTTCTTCAAAAAATTTTTTCTATGAATTCCTTGAACGACTCGCGTTCCTGAGCTACA
TTATGCTCGATTACCTTTTCAAGATTATGACTCATTCGAAATAATCTTCAATTTCGTAATCATGGACATAAATCATTATAGTTTCTAATACATCATC
AATACTTTTTCCTGGAGCTGGAATTACGTAAAAATATCCTGCTTTTGAGAGGTCTTTATAAGTTCCAATCAAGAAATCATTATTCTCAAGATGTAAC
TCTTCAACTAATTCATTGACAATTGAATGGTATAGGTTTGGTAGAAACTTATATAGCTTTTCTAGAATATCAATTTTGATTGTGTATTGAACCACGG
ACTGAGAATCAATAATCATAGACCTTCCCCTTATGTTTCTGTTTGCGATTAGATTCTTTAAACGCTTTCTTCTTATCCTTATGAACAGAAGCTTTAT
TAAAATTATGCTTTGCGACTAAATTGTTCATAGTGCTGAATTACCTCTCTTAAACATTTGCATGTGAATGAAAACTTTTTAGCTACACCACATTCAA
ATATATGTTCTCTTAAATCGCGTGTATCGGTATATCCCATCTCAACAATAAAATGCCGTATTAGATTTTTATCTTTATCGTTGAGAGAATTAAAATA
ATCGGATTTTGAATTAATTTCCCTGGCCAATTTGAATCACCTTCAGTTGGCGTTTTAGCTCTTTTATCATCTCTTCGTTCATCGCAATATAAAGATC
GCGTAAAGCAAGTTTTAGCATTCCATTTACTGGATAACTAAATGGACATACATAATCTTTTCCTACGAGCTTTTTGGTGAATTCCATATCACAGAAC
TGAAATGCCGGTTCATTTGTATAAATTCCCCAATTAGTTGACATCATTTTATTGGCATATTCCAACGCCTGGATTTGATTCTTAATTCCATCAATTT
GAAACTTTTAATATTCATTAGTAAAGGTCCTCAGAGTAAAGTTCTTTTTCACTACCACCACGTTCAATACGCACTTGTCCAGCGTAAGTTGCAATA
ATCATTGCTTCTTCACGTGTCCAGTAATTGCTATACTGGTCAATAAATCCTTGGTCTTCACCACAAACATGGTCTGATACAAGTTTATCACTTACCT
GGTCAAGAACTTCAGCCACATATCTTTAGAATAATGACGAGCACCAGGAATAACCAGAGTCCCACCATCTTTTAACTTAAAGCGGTTGGCTGCACACAC
AATTCGACGTTGATATTTTTCATTATTGTTCCAATGAGCTACTTGCCAACAGATTTCAGGAACCTCTTCTAAAACATCCTCTTCCGTATATTCGGTG
TAGTCGCCATAGGCCTGTAATTTAGCTGCTAGACTTTCTGGAGTTTCACGTAATAAAGCCAGGTCTAATAATTCAAGACGCTCTTTGAAGGTTTTCA
TTTGGTTTCCTCAACACTTTTAATTTTTATAGCTTGTTTAGAACTTTCAAAGCATTGACAATATACTCTTACCCGCATCAAACTGGTTGGCCGCTTTA
AGATGGACTACACCTTCGCCGTTATAAAATTCTACGACAATTTTAAATGTTTTCATTTAAACCATCCTTTAATACGTTGCCATAAAGTTTCTGTTG
AGCTTTGTTAACACCAATTGAGCGAATAACTGGTTGAGATTCATGGAATTCTTTATAATCAGCAAGATAAATTTCGTAAGCTGAATCCATAAAGGAA
CTTATAGCTGCCATGAAATTATTGCGAATACCTACTGGACATCTTTACTTTCACGAATAATCATGTATTTGCCAGTCTTAATCTTTACAATAGTTC
CAAGATAAGCCCCATGGTACCAGATGTCCCACCCCTCCTGAGTGGGTTCTGCACAACGACGAAGTTCATTGACAATTTCTAACTTGTTCATTATTTA
TTCCTCACAGTTCAGATGCTACAGTGATTACAGCTTCAATGTTTTCTGCCGAGCGTTTAATGTCAAGATACACATTACCGTTTTTAGCGATTTTACA
TGACATTCCGATGTCAGTAAATTCTGAATATGATGTTCCATCATTTTGTATCCAAAAATTCGCATATTTCCATTGTTGTTAATTTCAAAATTACGA
ATTCCGTGAGTGCGTTTTTCTAAAATAGCGAGATAGTTACTACGATAAGTTTCAACCTTTTTAAGAACAAATCCATTTTCATCTAAAAGTTTTAACA
TGAAGTCTTTATCTTCTTCCATATCAGAAGTAATCTCGCGAGCTTTACGAGTTGCTCGTTTTTTCAGCAGTTCAGGAGCATTTTCCTGTGCATATAA
AGTTGCCGCATTTGAAATAATATCCTGAGCTTCACCAGTAATGATTAATCCATCACCAGATTTCTCCACCAGGCCTTTTTTAATCAATACCCCAATA
TTACTATTAACTACTGCGTTACCTAAATCTGGATGCACCTCACGAACTTCTGCAGCTGTAATGAAATCTTTCTTAGCAATGGTAATTAAAATCGCAG
CAGTTTTTTCATTCAGAACATCGTTAGAAGCTTTGATGATGTAAGTTACTTTAGACATTTTCTAATCTCCGTAATTCTGTATCAGTAGTTGATAGTT
GTATAGTACCACAGTATGCTTTGGTTGTAAACCGTTTTGTGAAAAAATTTTTGAAATAAAAAAGGGAGAGCCGAGGCTCTCCCTAAAATTACTGCAT
GACTGTGATAACTGTCATGATAACACGTTGAATTCCGAACGCAAGAAGACCTCCTGCTACGGCAGGAACAACACCTAAACCCGCCAGTAAAATGCCA
CCAGATACTAATGCAGCGCTTGTGATACCAATGAATGGACTCATTTGATTTCCTCTAAATCTTTGGTGTATTCTGTAACTACATCAGTAGTTTTCCA
ATATTCGTTTTCTTCTTTTTGGCTTTAGTTTCTTCAGCAAGTTTCTTTGCTTCGTCGGAAGTCATATGAAAAATGTTCATTCCAACTAGTTTATCA
ACATAAGAAGAATACATATCAATTTTAGAAAGTTCTTCGGTCAGTTCTTTGCGAGTTTTACCTTGTACAACAATTTCACCTGAAATTACTTTCTTAA
TGAAATGTGCCTTGGCAAAAGCTAAACGAAATGCTGATTCAGTTTCTTTGATTTTGTTATCAATTCGTTTTTGGACATAAGTTTTACGAACTTCAAC
GAAGTCTTTGATTAAATCAACTACATTATCGTAAACTTGCAGCTTTCCTTTCTCATTAATGACGGTAATATTCTGGGAACGACGCTCAATCAACCCG
AAGTCTTTCATAATTTTTGCATGACGTTCTTCTTCATTATCGCTCAAAGAATATTCTTTGCGGAATTTAACTTTGAATCCAAAACCATGCTCACCGC
AAGCATCATCCCATGTAATGAAGCCTTTATCTTCAAGTGGGTCTAAGATTTTCATGATCATACTTTATATGGAATCTCAGTGAT
ATGCATTTGAGTTCGTGAAGTAAACTTATATGTTCCACGAATTTCATATTGCCCATCAATTTCAACGACTTCACCACGAAATTCTGGGAATTCTACC
TTCCGTTTAGTTACTTTCTTTCCTTGAAGAGCTTGTAATACAGCTTTCTTAACAGAAGAAACACTATGAGGAAGAATGTAAGTTGCATAACCAGTTG
CAATACCGGAAACGCCATTAAGAAGAACAGTAGGAATAATAGGCAAATAGAAAGCAGGCGGAATGTGTTCTTTATCTTGATGTACCGGAGCATATTC
AGTATCTTTATATACGTTATAGAAATTTTTACTTACACGAGCAAAAATAACGACTTGCTGCTGCTTTTTGGACGGTACGAGAACCAAAGTTTCCT
TGACCATCTAACAGAGGAAAATTATTATTCCAAGTGTTAGCCATCAAAAGCACCTGCGTCTTGCGCAGAGTTTTCACCATGATGGTATATCCAAGGTCCG
CTACACCACCTGCAATAGAAGCGAGTTTGTGAAACTTATCTTTATTTCCTCGTGCCAAATCAAGAGCTCGAGCAATAACAAATCGTTGAACTGGCTT
AAATCCGTCAATCATATTTGGAATGGCACGATTTTCAACCGTGTACATAGCATAAGCCAATGCTTCATTATCAATGATACTTTTTAAATCGCGATTA
TTCAGTTGCATAAATTTACCATACTAGTGAATGTAGTGCCATAATAACATCAGAAATGAAAAGCACGACTTGAATTAATCCGAACATTACTCCATAA
TATAGTGCTACTAATAAAGCAGCAAGGGCTAATGAATAGCCCAAGATTTTCTTAATCATTAGTAGATAACAACACAAATGTTAAATATGCACACATA
CCCTGGGCTAAAGCTTGTGAAAACACACTGCTAGCATCGATACAGATAGTTAAAACACATGCTACTATCCAACAAATAAATGAAATAACTCCTAATA
ATTTTGCGATATTCATATTTTCCTCACTGGCGTCCGAAGACGCCCTTTGTTTTTAAGATTGTTACGATAGAACTGCATCACATGTTCGTTATGGAAAT
```

Figure 11(F)

```
TACTCATACACACCACACATTTTGCATAAACGTTCAAAACAGATAAATCCGCCACCTACACACATCACGACAGCCACATTATCATTAAGAGGTAGAC
CTAAAGCCGTAAAGATTCCAGTCAATGTGAATAAGGCTAAAACTAATAGGTAACCCATTACAAATAGAGCTTTCATTAGTATGCCTGCAAAACAAAT
TTAAAGTTATCAGCCAACATACGGTTCATTTCTTCAAGTGTTTGATACTCAGAATGATGATTACGAGTAAACGCTAAAGCTAACTGACCTTTTCCAA
ATCCTGTCGTCAAAGGTTTCATCTTAGAAGCAGGAAGATAAAATACTGCATATGGAACATTGTTATTTGCAATAGTACGCGCAAGCTGAGACCGACG
TTGACGAATATGACTTAGAACTGCGCTGAATCCTTGCTTAGAACGTTGATTACCTACATAAAATCGTGCAGACACACATGGATTACTAAATGGACGA
CCATCTAATTTACTTACTAAAAAGTAAAATCCAGGTTTAGATAAAATATCTTTATGCGGAGTTCCCAAAAACCACTCACCACCCTTGATTGTACCAA
TAACAGTAGCACCTGCATCATTCAGATCAGTAACAGTCATATATTTCATATTAATTTCCTCTAAATTATTTTCTACTCCAAGGCCGCATGAATACGC
GGCCATTAAATTAATCGTCGCAGTCGACGCTCAATTCCCAAAACTCTTCTACGGTATAAGTTTCAGTATCATTTTCAATACAGAAACGTTCATTACT
GTTATTTGCTAAAGTAGCGTTAACTGTCATTTTCTCGCTGGTGCTCTTAAGAGGTGAAATACGAATTAACTGATCACCACTATCCAAGCAAAAAATT
TCACCAACTTTTACATCTTTAAAGATTTTCATAATTCACCTCAAGGAGTATAAAATCCAAATGCAGTTGTTGACCATCCCATCCAATATGGAAAATT
TGCGCCAATGTAAAACATAAGAATATAAACCAACCACTCAGCAAATTCATCATTTTACACCATTCCAAATTGTTTCAACCACGGATTTTAAACCAT
TTTGATGAATATCCATTCCGACTACCGTCATCAAATAAATTCCAACTACAACTGAACCTAAGGCAAAAATCAGCATGAAAATGAATAAAGCCGGAAA
AATATTATCGAAAAACCATTCAATAAATGTAAAAGCACTGCGTTTACGCTTCATATTTTCCTCACATAAATCCAAAGTAAACGTTTAATACATCAAT
CATTAAAACGATTGGGAATATACTCAAACTATTAGTATTATAACTACATTCCATATAGCTTTAACAATCTTTTTCATTTTCTGTTCCTCCGTAGTT
GATAGGGTAATAGTACCACGGAAGAACAGTCTTGTAAACAACTTTTTAAAAATATTCGTAATAAATGTGAATACCAATCACCACTGCTGAAACCTGT
GCAACCCACCACGCACAAGCAATAAGTACAGAATTCAAAATTTTCATAATAACCTCATCACAAAAGTAAATGTTAAACAAATTAATGGAATACTAAT
TAACCAAACGAAACACCACCATAATGAACTCATAGTTCAATCTCAGCAATTTTCATTTCATTACTATTAATAGCCGCTTTAAGACTATCTGAAAGAA
TTACATTCCAGTGGTCATTCATATGACCATTAACTAAGCGTGTAAATTCTTCGGGAGTTGAAAAATAAGGCGTATCAGACTCCCAATGCGATAATCC
TAAGCGAGTATAAATCATACCTTCATCATCGCTAGAATATTCAACTGACACAAACTCATCAGTTATTTTATGTTTAGCGTAATAAAATTTAAATTTC
ATTTTCCGCTCCTCCGTAGTTGATAGTTGTATATTACCACGGTCCTTGTGGTATGTAAACCGTTTTGTGAAAATTTTTAAATGGAAAGATACCATCC
GTTGTAGTTGCTTTTTCTTACAACCTTACGAAGGTCTTCTCTGTCACCGATGAACTTCGGAGTGTACTGGATGACACCTGGGTGAATTTCTTTAGTG
TTGAATATAATTATACAGTCAGCGACCTGATGATTCAGAATGGGCCCTAGATTTATTCCAGAACCATATGGATACTCTCCGCTGCATCCTGTTGTTA
CAGAAATCCAACGTGAGTCAGTTTGATGTGTCTTAACTTCTACACGAAGCCCGCAGTATCTTGGATGCGGCCAATACATCCCATGCGTATGTATACGG
GTCATTAACGTCCTCTTGGCCTTTGTTAACATACCCGCTTAGCCAATCTGCTACAAAAAACTCTGCGTACACCGCGATACGGCATCTTTCGATAACT
TCTGCCTTATCCTGATTTGGGTTTTGTTTTAAAGAGTATCTTGCTGTATCAGCAATTTTGACCTTCATTTCACTAGTCAAATCACTGTTCGATAGGG
TAAATGTCGGAATCTGAAATAGTCTCTGTAAACCCGGATTCGTTTTCTGCATTTAGACTTTCCTTTTTACCGCTGAGATAAGCGTTATATACTTTAA
GAGTGCCGTAATAAATTCGGTCATTTTCATCTAAAGACTCACGGTCAAGTTCATCGAGTTCCTTTTTATCCATGACTATAACATCATTGCAATAAAG
AAACCCAAGTTTTTGTGTCCAAACTCAAATTTATTACAGTACACAATATTAGCGTGATGATTACCATGTAGAGAAATTTCTTTTATGTCGGAATCA
CCGATATTCATACAATAAATCATAATTCACCTTAAAACAAAAGGGCCGAAGCCCTTATTTTATTTGAATTGTGCAATTCTTTTCTCTAAACAGTCAG
CATAAGATTTCATTGAGATAAACTGCGAAAGTAACAGTTCTTGCTCAACTGCACTAACTGTTAGAAACTTTGCGCTTTCTAAAAATTTGCTCAGTGC
ATTAATTTTGAGCATTAATTGATCGTATTCTTCTTTTACTCGTGCTTGATAACCTAACATAATTTTCCTTAGTTAAGGGCCGAAGCCCTTATTTAAA
TTGTTCAGTAACGTCTTCAACTACTTCGTATTGACAGGTACGCATTTTAGCATCGTTGTAATCAATCGGAATTGATACTACATCACGCGGATGTACT
TTAACTTTTACAACTCGGCTGGTTGAACTGCCAAAGTGACGAATATAAGATTTAGAACACACATGCAGACCGCGAGACAAGTTTGTGTATCATCGT
CATTCACACGAGTACGTGGCATTTTAACTACTTTACCAGGACTGTTATCAAAAGTATTTGAATGACAGTCAAAGTAGTTGTCACGAACTACTTTCCA
AGCATAGAAGTAACCATCTTCGGTGATTTCAATATCGTTTGCTACCAAGAAATCAAAGAGTCGAGATACCGCTTTCTGGCTTGGGTTTTCCAGCAGA
TTTTCCAAGAACGGAAAATAAAATTCAAAGTTTTCGCCTTTTTCCATCGAATCAAGAATACGATCAACCAAACCAGACCGCAATTCAATATTTTGAT
AGAATAAGCTTCCACCTTCAATTCGAACATCGCCGGAAATATATTTTTCAACAGCGCGACGAACATTAATTTTTTGTGCCGCTTCTTCCAGCTTATC
CGCTACAAGCAGATTGAGAATTTCCTGGAAGTTTGAATGAGTATTAGGTGTTGCGTTATAAGTTACACCGTCAACAGTAATTGAAATGAATTTTTTA
GATGCATTCCAAATAATGTCAGATTTAGCAACTGGAGCAATAACTGCATCGCTATTAACTTTAACTGTAATATCACCGCTAATAGTAACTTTAGAGC
GTTTAGCTTCTTCAGCATTTTTCAAAACACGACGAATTGTGTCAACCGATAACCACCTTGCCAATCAGCCAATTCCTGTTGGGTGTAATTACCACTTGA
ATACAATTTAACAATTTCAGCTTGTTCGTTTTTGGTCAGGCATTTAATATTGTACATAATTTTCCTTATTAGGCCGCAAGGGCCTTCATAGTTTTAG
CGATTTGGGAAACTTCATCATCATTTAAAGAGTTGCGATAACCGATGAAGTCGGAAACAATACGGAATTTCTTGGTAAACTCAGCAACCATTTTATC
ACTATTTTTTGAAGCATTACGTGATAATTCATCAAAGAGATTAGTTACTGTCCAGATATCATGACCGATGGTATCTTTTCCACCATTGAAATACACA
CCGCGTAATGAACTAACCATATTACCAAGTCGTGTATATTCTTCAGAAACTTCGTCTGTACTGAAGTACTTCATCATAAAATCTAGTTCAGGATACT
TGATAATTTTATCAATATATCGTTGAGCTGAACTTGAATAACCTACATACTTATCATAATCTACATCAAAAGCATCTACATATAAATCACGCAG
AGTTTCAAAAATACATTGGCACTGACCGAGTTCTTTTACCTTTTTCTGCAAAAGCGGACGAATAACATAAAATTCATTAATGCCAATAAGATTAGCC
ATACGAATCAAAATATTCATAGATGGATGACAAAGAGATGTAGTACCATCCATAGAGAAAATATCAGAACGATGCATATACGCTACATACCCAGTAA
TTTCATCTGCTTCTGATGTGAGCGTAAATAATTCCTCTTTTTCCCAGCGCCCGTCTTTAATTTCAAACTTAAATGCTGTAGCAGCTTTAGGACGAGG
AGCTTTACTTTTAACTACCTTTGGAATATAGCTTTTAACTAAAGCTTCAATTTCTGACAAATAATGAATGTTAACTTCATCACTTTCAAACATCGCC
ATAATATCAGGAAGCAAATCAATCTGCGATTCTACTTCTGGATTAATAAACAGAAGGCGCTCATTGTGATGAATATTCAAAGTGTTATTAAATTCAC
TATCATCTAACGCATGTGCTAATCCACGGACAATATTAACACGATTTTTAATATTATCAATAACGATATTAATTTTTGTTGTATTAATACCAAACAG
ACGATAACTTGATGCAACGGCTGAAGTTTCATGACTTTGCTTAATGCGTTTCAGTCGAGGGTCAAGATTTACTTCATACACCACGCCTGCATTGCAT
AACTTACTATCAGGTTCAAACATACTCTGCATCTTCTTATATGACAGATTTTTAGTCGTGAATTTGACTGAATTACTAATCATATAATCTCGAGCAG
AATACCCCATCTTCATTAATTCGCGATATGTATGACGAGGAGATGTAGATTCTTTAAATCGTTTTACATCTTCATTAAATGCTTTCTCACTGAGTTC
TTTAACTCGTTCAATAATATTTTTACGAGTACGATCATCCAGTGAAAGAGCCTCGCGAGATGGAGCAATATCAAGTGAACCCATTGGAAACTTAATG
TAATTCACTTCATTGCGAATGCTTAGCCAGTTACGGTCTCTAATAACACCATCGATAGGATAAACAATACCGCATAGATAGCATATAATCCACCAC
GATCAGGCCAGTATCTTTCTGGATTTACACCGTAATAGTCATCAAAATCCGGAAAATAATCAATTTCGCGGTCAAGACCGTTAATGATAGCCAAATC
TTTGAATGGTCGCATGATATAAGAAACTTCATAAGCAAAGTTTCTAAAGTCTTTTTCTTCAACTGGAACTACGATTTCAATACCAGTTTTATCATCT
GGACCCATTTCTTTTACGAATGTAGGTTTAATTTGTGGACCATCACCATCCATGTAAGCTACATAACCACGAATTTCACCTTTATGATACGAAGTAA
TACTAAATGTATCAGTATAACTAAACGGAGATTTAGAACCTAAACCAAACCCGCCAATAAAGTCATTAGATTCAGCCTTAGTGAACTGAAGTATGA
ATTATATAACCCAGGAGAATTATCATCACCCTGAATATCAAAATCACTCATACCCGGACCAAAATCTCGACAAACAAATCGCGGATCTAATCGTCCT
GGAACTTGTATGATAAATTTTTCAGGATTTCCATTAAGTGCATGGGCATCAATCATATTAGTAATTAATTCACGGACTACTGCACGAATCTTGTTTG
TATACAAATCAGATGACAGAATTTTAAATACTTTAGGAGATGCTGTGATGCTAAATGCTTTTGATTTAGAACCATTGCCAAGAATTGTTTCTTTTC
AGTGGTGATAATCATAATTTCCTCATTAATTCATATTACGCTTAATAACTTCAGCAACTTCTAGTAATTCATCTTTAGTTGCAGTGTCGGATTGAAT
TTTATCTCTAATATCTTTAAAGCGGTTTTTAAATTCTTCGGCTTCTCCCATATCGAAAAAGCGTTGAATGATTCTATATTCTCGATGAACTGCTTTA
TCAAAAAGTTCTAAATTTACTTTATATGATTTCATTTCAATATCCTCATTTGCCCAATTAATTATACCACATCCTTGTGGTAAAGTAAACTACTGGC
```

Figure 11(G)

```
TCATCCATTCTTTACGAAGGTCAGCATTATCTCCCATGAGCATTTCAAAAAGCTCTTTCCAGTTCTCAGGAAGTTTAACAACATCATATACTGGATT
TTGAATCATCTCACGATATTCAGATTTTTCCAAAGAGCCAAGTCCTTTAATATAACGGATGCTATGTTTAGGTAGAGCATCTTTAGCACTCTCATAT
TCAGCGACTGTATAAAACCATTCTTGTTTTTTACCGACCTGAGCGATGATTACAGGAGTTTTGACAAAACGAATTCTTCCTTGCTCAAACAGTTCTG
GCCAATTACTAAAAAACCCGAGCAGAGAAGGATAAATGCTTCCTAGACCATCATGGTCAGCATCAGTCATAATAGCAATATTATGATAATTCAAGTT
TTCAGCTTTTTCACCGAGAACTAATCCAGTGATTGCGCAAATATCAAACAATTCTTTGTTTTTAAGCATATCAGCATATGACATACCCCAACTGTTG
AGAACTTTACCGCGCAATGGATAACCACCATGAAGTTCTTTATCACGAACATCAATAAGATATCCGATAGCAGAATCACCCTCAGTCAAGAAAAGAG
TAGTGTCAGCATCTTTACCGCAAAGATTCGCTTTAATGTGTTTATGAACCTTAGCTTTAGAAGCCTTTTTAGCTGCTTTAGTTTCTGCTGCCTTTTC
TGCCGCCAATTTACGAGCCAAAGCAGCTTCAATAATTGGCATTAGAATTGCTTCATTATTTAGAATAGCACGTGAAATCTTTTTAGCATCAAGTTGA
ATATGACTACGGATTTCGCCAAATGGAGAAGTCAAACGCTCTTTAGTTTGAGAATCAAATCGCATGTTTTTCATATCACGGACAAACATAACGATAG
TCAAACATTCTTTAACGCGTGCTTTAGTCACATCAATTTTGAACTTACGTTTGATTTGTGGAATAAGGTCTTCACAAATATCATCCATAACACAGTC
AATGTGATGGCCACCATTCTTAGTGTGAATGTTATTGACGTATGTTAATTGACGAAAACCATCCGGTGAACGACCAACCGCAATAGAGCAATTTTCT
TGTTCTTGAACAATAGCATGCTCATCATATTGGCGTGCATATTTCTTAAAATTGCCCTGAACCTTTTTACCATTAAAGGTAAATTGAATATCAGGAT
AAACTACTGCAAGTGTCTGGAGACGATCTAGTGTAATGTCAAGATAAACTTGGGACAGCTCATTAGTTTCAAATGACATAAAATCAGGAATGAAAGT
AACACGAGTTCCTTTCCATTTTCCAGGAATAGTTTCCCATGATTTATTTCCATGCCATTTGAACAACGAACTACAATATTATTTTGACCATCACCA
GTTTCACCGACAAACATCACAGAAAAAATGTTTGTCAAACTAGAACCAACACCATTCATACCGCCAGTGACGCGTTCTTTATCATCACCGAAGTTAC
CACCTGCTTTTGGAATAGTCCATGCAGCAACAGGACCAGGAATTTCTTCACCGGTAGGTGTTTTAACCATCGCCTGCGGAATACCACGACCGTTATC
TTCAACTGTTACTTGATTGTTTTTAATAGTAACATTAATTTTATTTGCGAATTTAAACTTAGTACGAATACCTTCATCTACTGAGTTATCGATAATT
TCATCAATAAGCTTAACAAGACCAGGTACATACTGAACACTTTCCCATTTACCAAACAGAAAGCGCTCATGCATTTCATTAGCAGAAGAGCCAATAT
ACATGCCGCTACGCTTTTTGATATGTTCAATATCGCTCAGAATTTTAATTTCATTCTTAATCATCACTTATCCTCGTTTGGTTCGGGAATATTATA
CTCCGGTAATCATAAAGCTAAAGGCCCGAAGGCCTTTTATTTAAAACGGATAGTCGAATCCTTGAAGAATAGACCAGAACACACGGTTCCTTCTACT
TTCTGCCCAGTAGGTCCAATAGCACGAAATCCAGTATGTTGGAAATCATTTTCAGAGCAACCGAACCAGTTGTATCCAGTGATTTCAATATTAGTAA
AACCACTTGAAGATAAAACTTTGGTTGCATTATCAGCATCAGTACATCCTGCTAAAGACACTGCTAATACTAATGCTGCGATAGAACGATTAATATA
TTTCATAGTTTTCACTTAAATTTAATGGCTTGAAGGAGACTAATAATTCTCAAGCGACTTCTTTCATCTTTAACCGTAAATGAAAGAGGGTCACCAG
ATTTCATAGTGATAGTGCATTCAAAATCAAAACCTTCGGGGACTTCTTCGAATAGGTCAAATTCTTCATCATATATTAGAACATTACTCTGAAAACT
GTGAAGAATTTTTCCATCATTTCCAGATGCTGTACTAATCATTGTAACATTATTACCTTTCATATCTTCAACGATAAATTCGCTTGTAGATATTACG
GCATTAATAGAACCATTCCTATAAATAGCAGAAAATAGATATTTCTTTTCTTCACCTTCGCGAATGCGATATTTCTTACCAATTTTAAACATAATTA
CCCTTTAAGTAAGTCGTAAAAACCACCATTCACATGCTTAGGAGCGGAAACTAACGAATAGCAATCCGATGACAATCAGGACATACATCAGTATCC
CTTTCAGAAATTTTCTTGATTTTTTCGTATTCTTTTGCACAGTCTTTGGATTGACATTTATAATCATAAAGCGGCATAATTATTCCTTAAAGTGTGC
TTTCAACATCTGATACAAGGACCATGCTTGTTCATTATTTTCAATAGTAACGTTCATAACCGGGAATTCAGATGGATCAGTTATTGTTGCAGATTCT
TCCTGCTCTTCAGCTGCCTGGTATGGATTTTCAACTTCATTAAAGAATTCAGCTTCATTCGATGAAAGCCAAATAAAATCTTCATCCAAAATATCTT
TACCAGAAGATAGTACTAAATTTCCAGCAAATGACATAATTTTAATAGGACGCCCAAGAGCATCCACATCTAAAATTTTAAAAGGATGCATACCTAA
ACGGCGTGCATAGATTCCGTTATCAGTATGGTCTTTAATAAAATTTTCTTGAGCTTGTTTATTTTTAAATTGATACCATTTATTAACTTCAAATTTA
ATAGCCATTAATAAATTTCCTTCCAGTAAGTTGTACCATCTTCAGTGATTTCACGAAATACACCGTAAATTGTTGTTTATCCCCAACCTTTTCATA
CACATAAACCGAAGTCAAGTGAGTAAACTTAGCAGTGTGTTCCTTTTGAACTACTACCAAATCTGGATCGAATAACACATCTTCAAATTCGTCATTA
GTGCAGTTCTGAACAATTTTACGTTTCATTACAATTTCCTCGTTAATTGAACATTGGAGCGATGCGTTTCAGAAGAGTAGCAGCACCTTTGGCAAAT
TTTCCATTTTATTCTCCAAATTATTTTCTATATCAGTAGTTGATATTGATATAGTACCATAATCAACTACTGATGTATATAGTTTTATGAAAAAATT
TTAAACTTTATGCATAGCGAGCTTTGCTGTAGTGTTTAATCCAACTTTCAGGAATGACTTTGTATGTTCCTAAAAATACCGCGTTGTATAACTTAAC
GCCATCTTCTACCCATTGATCAGTAATGTATGCACACATAGCGCGAGTACGCCGAGGAAGTGGTTGTCCACCTTCGATAAATTCAAACTCATAAGGA
GCAATGAACTTGATAGCTTGACCGAGTTTCCACTTAAAGTCTACACCTACATGCGAAGTATCAATCGTTTCAATTCCTTTAGCAGGAACAGCTTTCA
AAAACGCAGGCTCAAGAAATTTCCATCGAACATAACCAAACTGAGGTTTAGACTTTCCATCTTTAGGAATGATACGCACTTTTACTTCAGAATCTTC
ATCTTTAACGCCGTGTTTAAGCTGAATGCTTACAATTTCGACCAATTTTCCTGCTGCTTTAGAACGGGATTTATCAGATACACGAGCAATTTCACCA
ATATTAATAATCATAGTTATCTCTCACTTGTTAAAAAGATTTTATACTCCACAGGACCATTATACTCTGGTCCCAAGAGTTTGTAAACTATTAATTC
AAAAATAGCTACCACCGCACTACGAGGTACTACACTAAAATCTCCTGCATGGACAACGTTCAGAAGCTCAACACCATCTTCAATCCACTGGTCTGTTA
CCCAACCACAGATAGGATTATCAAAAGGACGACGGATAGACACAGCAGCACACAACAGGTCTGTAGGGTCTTGTTCTTCAACTTCTTGGAACAGGAT
GAACTCATCTTCATAAACCAGGTTTTTCTTTATTTTGTTATTATCTAACCGGCGACCGTGGATGACGTAAGATTTGTCAAACCACTCACTTTTGGCA
AATTCTTCAACAATAAATTCGCCTTCGCCAAAAACATCAGTCAGAGTTTATGACCAGAAATCAAGGCATTAGTTTTAATTTTAGGTTCAACCAGTT
TGTAGGTTTTGCCGATTTCAATAGCGGTAGTCATAGTAGGTTCCTTAATTTCCAGTGGTTTAACAGGGCATACATAAGTACTTACAACGTCAAAATC
AATCAGTTTAGCTGCCGGATTCGGTGTGTATTCAGGATTATAATTAAATTTCATAATTTATCTCATTTCAATAAAATCTACAAGTTCAGCATGGGATT
TACGGAACATTACTTGATGCCCGCCAACGATAACTTGGTCATCTGGTACTTCGTATACAGCAAGATAAAATCCTTTAGAAGATAATTCTTCCCGCTC
TTCTCGTGTGAACCATCTCATCATATTCGCTAGCGAAAGCAAAATGATAAAGAGCTATAAACCATCCTGGAATATGATATTCTACTCCAACA
TAATCTTTCTTGAACTTAGTATTAATTACTATATTAGCGTTTTTAACTAATAGTTTATCTTCGTGTGGTAAAGGAATTCTTTTATTATTATCGCTAT
GATGCATAAAATTAGGTCTGTCATAACCTACATGTAATAGCCACTCTTCGCTCCATGAATCTATTATACTCCTGTACGGCGTTATTTGAACACAAAG
ATTTCGACGTATTGTTATAGCATCTTCATAATCAAGAATACTAAACGATGATTCAACACGATAAATTTTCATTTATTATCCTCAGTAGCTATGGTG
TTATAATACCACAACTAACCGAGGAAGTAAACAACTTTTTATCGTTTTGTTGGAAGAGATAGAGGATCGCAATCTTCCTCTGATGGAGCATCTTCAA
GACCCATAGCATATCGCAAAGCGTACTTCATCATCAGAATATCTTTGCAGGTCATGAATAGAATCATGCGCAACGAATCCATCTAAAGTTCCTTT
TGGAAGAGGACACGTGGTCATATCCGAACAAGCAGAAGTGCTTCAATTCTGGTACGAATATCACGCTGATTCCAGAATTTACATGGTTCTAACTTA
AATGTGTCAAGCTCATTCTCAGAAACACCATTAAGACGTTGAATATCACGAATGAGATCGACTAAAATTGGAAATCAAACGACATTCCACGGCACC
AGCCTTGAGATTTCCAAGGATCGATATTATGTGCATTGATGTAATCATTAAATTTTGCAATACCATCGATGGTGCTTACATCTTCATCTGATGGTGC
AATATTTTTCGAGCTTCAGGAGACTGATTTTTCCACCATTCGATAGTGCTTTTAGTAAAAAGACGATGTCCTTTTGGCTTTTTAAATCAAATTTG
ATTTTAATGCCGCGTGAAACTAATTCATCAAATGTTTCAACTACTTCTGGGTTAGGGTCAAAAGCAATTACAGCTAAATCAATAACAGCTGCTTTTT
CACCACTTCCCATTGTTTCAAATCTATAATAAAATCAAACATTAAATTTTCCTTGCTAAATCGCGAATTTGACCTACAGTATAGTCTTGAATATAA
ACTTTATTAATAGGTTCATCAATAAATTTTGCCATAGATTCAATATCTTTTTGCATCTCTTCAAGACTGTATATTATCTTTAAAGCTTTTCGCGAA
TAGTAATATTTTCAGGACCAGAATTTTTCTCAATGACAGCTTTAACATTTGTCATAAGAGATTTAAACTGACACCAACTTAATTCAATCATTAATAA
CCGCCTTATAAAGATGGCTAATTTCACCTAAAATGTAATCACTGATTGTAACAGTTTTTACTTCACCACAAAAGAATTCTAACGCAATCAAATCTCG
TTCAATTTCTTCCAATTGAAGCATTAACTTGCCTGATTCAATTTTCACGTTTTTGCGATTTTTACTATAAGCTATTTCATAAATTTCGCTAACTTTA
TCCTGAAGAAGATAAAACTGATCTTTAGTTATTTCCACGAATAGCTTCCTCAAATTTAATTAGTAATTTACAGACACTTTCATCTAGTGTAATTACC
```

Figure 11(H)

```
GTATCTGTATTACTGTGATATGATTGTTTTTCAATTCGTTTAATTGCTAATATAGTATCACTTATAAGATAAAGCTTATGAAGGAGCTCAGCTCCTG
TTACCATAACATTAAGATTATCTTGCTTATTAGTATGCTTCCTTATACCATCTATTAGACGGATTTAAATATTTTGAATTGATGTTAATCATATAGCC
TCACACATAAAACACATCATAACGACCACGGGTAACACCAACATAAAGAAGTTGTTGGGCCAATTCAGCATCTGCATAATGAATACAAGGCGTATAA
ATGAAAGCACGGTCTACAGACATACCCTGAGCTTTATGGAATGTTGATGCAGGAAGTGCTTTCACTTTACTAAACTGTGATTTAGCATCCCAAAAAT
CACTCCATGGAGCTTTTCCGCCTTTGTTCCAATTTTTATAAGTTTCTGCTGTTTTACCTAAAAATAGATTAAACTTATATAACTCTTCATCAGATGA
AATTATTTTAATCTTTTCACGATAATATTCATCATCGCCGTAAGTTTCTACTGTTAAATCCCAATGACGAATTAGATATTCCCCAGGAACACCACGA
GCTTTAACAAACGTTGATGTATACTCAGCTTCTATAATACGAACTAATTGTCCGTATTAAAATAATTTCTGATACAGGCTTTCCATCAATTTTAT
ATGTTTTAATTAATGGTTCCTGCATTACAATAATTTCACCAACAATAAAATCTTTATCAGTTTCAAAAATCTTTTTACGAATAATGCTATTTAACTT
ATCAACAGATTTATTCGTAAATGCCATTACGCGATTTTCAAACAAATCATCTAGTGATTTGACGATTGAAAAATAATTTACCATAAAATCGCGTAAA
GCGGTATCACCGGTAAATCCACGTACTCCATGCCCGTCAACAACTTTATCATAAATCCACTTACCGTTACGAACATCAGTAGCTACATCAATAATAG
GAGCATTACTGCGTTTAACTTCAGTAAGTTCACACTGATAAAAATCTTTGTGTGTAAAGAATGGACTGATATAAGCAGTATTTTCTCCTGGGTCAAC
AGGTCTAATTTGCTTATTATCACCTATTCCAATTATGGTACACCATGGCGGGATAGTTGAAAGCAGAATTTTAAATAGCTTTCTATCATACATTGAC
ACTTCGTCGCAGATTAATACTCTGCATTTAGCTAAATCCGGTACTTCTTTTTGTTCAAAAAGAACGTTTTCTTCATATGTTACTGGGTTAATTTTAA
GAATGCTATGAATAGTACTTGCTTCTTTCCCTGATAGTTTTGAAAGAATCTTTTTAGCCGCATGAGTAGGAGCTGCTAAAATAATACCAGTTTCACC
CGTAGATATTAAAGCTTCAATGATGAACTTAGTAAGAGTAGTCTTACCGGTACCGGCAGGTCCATTAATAGTTACATGGTGTTTCTTTCTTTAATA
GCCTTCATAACAATGTTAAAGGCATTTTTCTGGCCTTCGGTCAAATCATCAAATGTCATCGTAAATTCCCTGCAATTGGTATACTAACAATACGCCC
AGTATCTAAAATTCGCTGATATAATCTTTGTGTGTCTACGTCGGGCTTAACATGTTTAACTTCTATTTTATTAAACCAAAACTTGCGTGGAGTCTCA
ACTAATCTTGGAATTCCCTTACCTAAAGCTAATCGATACTGCTCTTTAAGAGTGGTAAATACTTTATCAGCAATCTTCCATTCAAAAAATACAGCAG
GACGATGTTCATCAAGTGGAACTGGCGCAATAAATCCATCTTTGTCTCGGTAAACTATCGCATATACATAAACCATATTATCCTCGGATAAGTTTAA
AAATTGAACAATTTAGCGGATATCCTCTTTTCAGTTTAAGTTTATCAATAAAAGACAAGTTTTGATACCGCTCTACACCTTGAATAATTTTATCACA
CATATCATATTGCATTTCTGCTTCTGACAACTTTTTCACAATTTTCCAATCCGAGCCTTTAAGAAGAACGTTCAGTTTAACAACTTCAGCGCCTTCT
GCTATGCGAGAACCATCAATACGAGCTTTAAGTGCTATAATCCTTAGCTTAATGTCAGAGGTTTGTTTTGATTTAGAAAGCTGTGAAATGTGTTCAA
TTCCGGTTTTCACGTTTTTTCTGTATAGCTTTAATTTGATTATAGGTCTTTTTGATTTTAGCCCATTTCTTTTCATCTAAATTTAGTTTATGAACTTT
TTTCGCAGATGAACGACCAATTCGCAAAGCAAATAAATCACGCTTTTCAATCAACTCCTCTAAAGTATAATCAGAACGAAATGTATTATACTTTTTC
TTTACTGCAATAACATTCCCTTTAATGTATCCAATGTTATTATCAAAACGTTCTAATGATAATTTCTCTCCTTCAATACGATTATCAAAAGGTTCTC
CTGAGTAAGCGCAAACTTTCTGATCTAAAATGTTCTTAATGTAATTGAAGTCTAAGTTAAAATCTTTAGAACGTCTTTTAGCAGATGCCTGAGTGTG
CTCTAAACGACGTTTAATTTTACGAATTTGATTATTAGACAGTTTCATATTTTTCTCACATCTTACGGACGATTTAATACTTACTATAACATTTTTA
CTTCAGATTGTAAACAACTTTATGCAAAAATGCTTTAAAAATTTCATGGTATAATGAATCTAAGTCCTTCCATTATAGATTAAATCCTTCAAAGTCA
AGAGTATAGATAGTGTATGTTGAATACTTTTTATACTCATATCTATCTGCAATTCTAAATACACTTCCAGCTGGTATCATTACTTCTTGTTCATCTG
AAACTAATTCCATATTACGATAACGATGGCTATCCGGAAACTTAAAGTTTGGATTGTATTCTTTACAGCGTAGAGCTTTTATAGCATACTCCTGGAA
ATTGAATACCATAGGAGCTTTGAATTCAAAAATAACCTGTGTGTTATACTCTAAACCGGAAGCAAAATGTATAGCTATATTTTTATCATATGAAGCT
GATACGACTTTATCAAATGTAATAATATCAATTCCTTGATTTAACGCTTGCTTAGTCTCGACTGGAACACCTCTCCAAAGAGGTTTATCGTTTGGAA
CCAAACGAGATTTGACTATTTCATTTAACCAAGAATGATCGTCTGGTTTATTAGTAATACAATGAATTAAAAGTTCAATTTCAGATAAATTAAATCC
TTCAGAAAGTAATTCTTCACGAATAGAAGCACGCACCGATGCATCCATTGATTTTATTTTAAAATCTTTTAGTTGCATTACTGAGTATTTCATTCAA
CTACCTCAATATCATAAACTTTAAATGTTCCAAATGAATCGTGTAATTTTTCTTTGAAATAGAAGTTATTTTATACTTTCCAATTGGAATCATCCA
TTCTTGTTCACGTACAATCATCATTAAGTTATCAGTACGTTCTGAATCTAATCCATCAGTATCTTCATATGTATACTTAAATTCAGTATTAGGAGAA
GAAAGTATAATATCGCTGATATGGTCAGAATAATTAAAAGCTTTATCAGTTTTTAAGCGAAATATTATTTCAGTGAAATACTCAACATAAGAAAAAC
CACATGCTGTGCGCAAACTAGTAGTAAATGAATCTACTCTGTTCGTTGAAAACACTTCTCCAACTTGTAAATCTTTAATGAGTTCTTTTGTCGATTT
TGATATACCACGATATAGCTGATAAGGCGATTTAGTTAAATGCTTTTTAACTATTTTATTCAACTGCCGATGAAGAGCTTCATTCTTTTTGGCTTCC
ATACACTGCCAAAGAACTGACTGTTCAAAGTCAGTAAATTTTTCAAACATATATCATATTGAAAATCGACACTTTTCAGCTTTTATAG
ATAACTGTTCAACATCTGCGAGATAATAATCATGATAGCCTCCATATACTTCAGAAGCTATCATATCATTGTTAGGAAGGAAAGTAAACAACTTTT
TGAATTATTTTGCCCAGGGAGCCCAAGGCGGAGGGTCAAGATGGTATGAAGCTAGTTCTTCTAGAAGAGCATCTGGGGCTTCAATTCCATAATTCTG
TAATACTATACGGTACTCTTTCTTATAATCACTAGAATCATTCTGGATATTCGTAGAATGATTATCTTCTAACATCTCAAATAAATCCATATTAATT
CCTAGCGATAAAAACCAAAATAACGATTAGCTTCAATAATCTTTCTTTCTTCTTCAGATATTCTCCAGCGTAGTCCAACATCAAAATGAGCCCAGAC
CATCTTAACAAATGCATTTATATCTTTAATATCTTCAATAATGAATGTTTTACTTTTAGAAGGTTGACCTGCTAAATTAAGTGCTAATTTAACTTTA
TCGTCTTCAAACAGGGCAAAAAGACCATATTCATGAGCTCTTTTATAGCCTTTAATAGTTAAAGCTTCAGAAGAAGAAAACGGTGAATCAGTATTCT
GTAAAATATCTTCAGTATGCTTTATAATTAGAATAACATTTTCTGGATATTTCTTTCTTTTATATCTTTAATTAAAAGATCGGATTTTCTGCTAA
AGGAATAATTAATGAGCATTTTTTATCAAGTGCATTTACTGATTTACCTTCTTTAGACATAAATTCTATTGAATAATGTTTTGCTACTTCAATCATG
CGATTTCCTCTTGCCTACTAATGGACCGTCAGGAATTTTGTTTTCCTGGATATATTTCTCATTTTCTTCCATCATTTTACTGCCAATTTTAAGAAGC
AAATCCATTGCTTCATTTGCTTTAGCTTTAAGCCTCTTCTAATATCATATCTCTGTTCACGATTTATCCCCATAGATGTCTCTCATTAATTTAAGCGC
TGAGCGTTCTAATTTCTTTTCTTTCTCAACACTAATCATTGATTTCATCCATTCTTCCGATTCGTTCTGCATTTCTTTATTTGCTTGTTCAACCCAA
CCATCATCAATATACATCGAGTTTGGTCTATTGAACCATTCAAGCATCTTCTTCAGAGCTTTCATTTGTTTTACCTAAAACAATAGTAGGAGCATCA
TCAAATTCATGAATTTTTAGCAAATTTGGATGTAAACTATTCCATACAGAAGAAATAAAGTATGATAACGCATCTTCACTTGCAATTATAAATTTAT
TTCCTTTATCTATTTTCCAACTATATAGTGAATCGTACGAATAAAAAGATAAAGGCTTATCATTATATTGTTCTGCGCTAACATTAATGTATTCGGA
TTTAGTAAATGCTTCAATTGCTCTAAATGGAATATTTGGTACAGTTTCAATAATACAATCTTTTTTAAGTTTTATTTCAGCATCTTCTGGAACTGGC
ATTGAAACGAAATTTTCTACGAGATACATTGGGTCACAATTCTTATCAATCATTACTGCTACGGTAATTGGAACGTCTTTAGCAAACGACATAC
TAATACTATTGATAGACATTTCAAACAAAATCGCTTCCATAATTTTCCTCAATCACAAGATGTAGATGAACAACTAGAATCACAAGAACTTTCACAT
GAATCGCCCGTCCATACATGAACAGGAACATTAGTATCATATGAATCAGAACTAGACTGTGTATTCTGTGCATTAGATGATGTAGTAGGTACTGACC
AGCGCCAAGGATTTTTATAATATTCTTGGGCTTCTTCATAAGTCATAGTAACTGCTTCTACTGTTCCATCTCCCATATAAACATACTCAACTACAGT
TAAAGGAAGGTAGTCATTTGAATAGGAACTACACCTTCTCCGGGAGTTGTAGAGAAAAAATCCGTAAAGAAACTTTTAAACCAATTAAAGATAAAC
ATTACAAAAAGCCTCTTTTGAATTCAACTTGCTTCTCGCCATAATCATATCGAATCTCTGCATTAAATTCAACAGAACCATCTGCGTACATCATAAA
TGAATGCACAACAACTTCTGTAGACCATGGCTGTAGTTCATATTTCTTCATTACATGCCGTGAAATGATAATATCTAAATCTTCATTTGGTTTAATC
CAGCGATTTAACATAGTGCTCTCCTCTATAAGATAATTCTATTATACCCATACTCATTTTGGAAAGTAAACCGGTAAAATGAAAAAAGGACTCCCGAA
GGAGTCCTTGAATTATTAACCACCTATTTCTGTAGGCGTAAACATTGCAGCATTCTTAGTTTTCCAAGTTGTTGCATCGGAAACTACATCAGAATAA
GCTGCTTTTTCTGACGGAAAGATTTGATAATGAGAATCTGCAATACGGTGTTCATTTGAATATACATCAAATGCTACAGAACTTCCATACCTTTAA
CTTCTTTGCCTTCACCTGCTGGATGAGTAAAGGTCTTGATGTTAACGAAACCACCCATAATAAACTCCTTTATTGTTTAATTACAGGTCTATTTATA
```

Figure 11(I)

```
TCAGTCTTCAATGAAAACTTGTGCCAGGAATTCGTGTTCATCTTGAATTTGTTTATATAAAGCCATTACAGCATTTATATTAGAGCTATCTACTTTA
AGTTGATAGGCATACCACTCGTATAAATTAATTAAAGCTTTTTGTCGTCTAATAAATTCTTCTTTGGATATTTTCATTTTGAATGCTCTATAATTAA
TTTTAAGGCTTCTTTACTGACAAAAATTTCATCAAGACCTTCTTCTACACCCCAATCAACTACACGAAGCTGATTAGATAAGAGCTCGTATGTGAGC
TCCTTGTCATAATTTTTAAATAGCTGGTCAATACGTTTCTTGTGGGCTTTCTTAAGCTGGCGTTTATTTAAACGAGCCATTAATAACCTCGGTCTTG
ACGAGCGAAGTTTTCAGCATTTTTCAGATAATAAAGTTTAAAGATTTCTTCAGCCGTAAGACCGAGGCCTTGGAACATGTTCAGAACGAAATGAAGA
ATATCAATCATTTCGAATTTAATTTCCAACTGGTCTTGTGGAGACAAATCAGTAATCAGAGTTTCACGTCGTTCACCATGTTGAGCTTTCCAAGGCT
TCCATACAGCAGATGCATCTTTTTCACCATTGCTCATACCACCAAGAGAAGTCAATAGTTCGCGGAATTCATCATCAATATAATCTTTCTGATTACG
CAGCCAATCAACAACTTCACCCGCAGTAGCCAAATCATCAGGATGACGGTTATATTCAGGTTTATCTTTAGCTAAACGAACCTGCAGAGATTTCTGC
ATATCAAGCATAACTTGCAACGGGTCTTTTTCATCACCGAGAATATCCCAGTATTCATTTTGAGCTTTATCAGCGCCTTCAATCAGTTGTGAACATT
CATTAAAGTATGCCATTATTTTTCCTTTCAATTCATGGGTTAGTAGATTAATTATACAATAAATATATAAAGCAATAAGGAGGACATATGGTACAAA
AATTAATGGCACTTGTTAATGCCATCAAAGGTAATAAAAAGCGTATAGCTTTTACTATTTCTGCTATGGTAGGAATTTTACTCTGGAACTTTATTTT
ATCACCTGTTGCAATTGCACATGGTATTAATATTCCAGTAGTTACTCTTGATACATTCGTAGATTTAGCATTCGCTTTAGTTGGGTTAATTTAAATC
TTAGCATATTTAGATAACCGGCATTTTAGCCATCAACCCCTGAGCAATATTATTTTTCATATATTCCATAATTTGTTCAGTGGTTGCACCTTCCTTTC
TAATCATATCATTAACATCTTTTGATTTCCAGGGAGATTTATCCCAAAACATAACCCTTTCTCCTGCATCAACTAATTTAGTCATTCGCTTAATAGT
GTCAGGATGACGAGGTTCATTATCTAAAACCCACACACGTCTATCTTTAAATGGAACAACTTCTAGGTCTAATTGACCACCTGTAATAGCTATACCA
TTTTCAATAAAAAGCGAATCTATAGGTCCTTCTAGAACATATACATCACCATCTTTGACTCGTTCGACTCCATAGATTTTTGTTGCCTCAGGATAAG
CTTTGATGGTGATATATTTTTGAGGAGCATCTTTCTTTAATGCACGTCCTTGAAAAGACTCAGCTTTTCCGTTAGCATTATAAATTGGAATAACAAG
ACGAGGCTCAGGTGTTTCCTTTTTATATGTTCCTGGAGCTATACTATTAACTAATTTAGGCCATTCAGTTGTAAACCAAAGATATTTCCATTTATCC
TTTGGAATACAACGAGCTTTTACATATTTTATAATTGGATGGTCTTCCGCCAATTTATCTAATCTGATGCATGACGGAAGAGATTTAATTATTTTCT
TCTCAGGTTGTTTAGGAAGTTCTTTAGGTTTTTCTACTGGACGACTTTTACCTTTTTCTTTTCTTATTTCAAAGATATACTCACGATATAAATCAGG
TTCAAACTCCTTTAAATATATTCCAGATAGCATAACACATGTGCCTTTATTTCCTGTAATTGTTACTGCACAATTACGAACGTTTTCTTTATCAAATTT
GCTTTATTTTGATCGGTTTTTGAATCTCCACAAACGGGACATCTAAACCGTAATTTAAAAGTTGAACTATTATTTACTTGTGCGAATTTAGGTAAAT
GAGCCAATGCACGGTATGCAAACTCATTATCAATCCAAGGTATTGATGACATTTTTACTCTTCTTTTTCTTTAGATTCCTCTTTCTTCTTTTTAGGA
ATCTGTTCAGGACCTTTATTTACTACAGCGCCTGACGTTGTTCCAGTAGAGATATTTTCAGGATTACCACCTGAATCTCCAGCTACCATATCTTCTT
TAATAAAATTCTTTATATGTTTTCATATTAACCTCTATTCATAAAAGCATTAAAAATTTGGTCATCAATAGATGGCACAGTAATATTTTCTGCATCAT
TTAGCAAATCATTAATTTCATCAGATAGCATAACACATGTGCCTTTATTTCCTGTAATTGTTACTGCACAATTACGAACGTTTTCTTTATCAAATTT
TAGGTTAATATTTTCGTAGTGAAAATCCTTTAATGCCGAATATATCTTTAAAATGAAATTGTCTTTTACTACAATAAACCCAACCTCACTATTAAAA
CGTGGTTCATGGAAACTGTAATAAACCTTTTCATCTATAAAATCGTATGAAATTTTTTCCATTTTTAAATATGAAAATTCAGAACTATACATATTAA
CCTTTATTCATAAAAGCATTAAAAATTTGATCGTCAATAGAAACATTTACTTTAGACTGTTTTTCTGATGGTAATTCATATCCACATATTACAATTT
TGTGATCAATATCAAAATACACAGAAGCAATATGATTAATGATGTTTTCAGTAAAGTCTAAATCAACATCAATATCTTTTGACCACAGCCCAAAGG
ATAAATAATGCGAGTAATTCGATTATCTTTAACAAATATTCCACCGACATACTCTGTGCTGCGTTTAAAGTTTACACGTTTCCTAAATGAAAAATAT
TCAGGTTCTTTATGAGCCCGACTCATAGGACAACAATGAGTAGCTAGAATAAGAGATGTCAAATCCTACACCTTCAATATGAGCCAACGCGTCATGAT
TAAACCAATTATAATCATATGCCAAATCCATTATATTGTAATATGTGAAAGGCACCGGATTAACATCATGTGTTGTACCTTTAAAATCTGCCCAGGC
AACGATTTCGTTATCTTTAACAATTACAAAAATTGTGTCAATAAGATATCCACGGTTATTTTCATCAGGCGTTATATTATAACATTGCGCATCAGGA
AATTTACCGTATTTAAACGGTGGATTTTTGTGCATATAATAAATCATATTATTCACCTGTGATTTCGGTTACGATATTTTTGTTATTAAAGTTTTTA
TCGCAATACAGAACATAATTATCTGCATTACACCACCAGACTTAAGTTGTTTTTGCACTTTAGCTTTCATTTCGGGACGATCGCGCTCAACAATAT
TCATAATATCCGCTTCAATTTGAGTTTCAACTTCAGTCTGATCTGCAGTCATAGACCATTCACACAAGTCTTTATCATATCCTGCCATAGCAGGCTG
AGCAGCACAAGAAGCCAAAGTAAAAATTGTAGCAAAAATAAATTTTTTCATGATAATCTCCTCAGTAGTTTATGTTTATATAGTATCTCAATTTCCA
ACAAAAGTAAACAGCTATTTTAAAACTTCTGCATAATCACATGTTACAAACTGTTTCTCTAGCTTAACGATTTTACGAAAATACCTTTTATACTGAC
GAATCTGCCTCTTCGTAGGACGTACAGCAAACTTAATAAATTCCACTCGACCAAATGGAGGACTTTCTTCTGCTGGAATATCTAACACCAATTCCCA
CGTATCCGCAATAAGTGCTTTGAATTGCGTATTTTTCCTGACGTTATACGGAGTAGGTTTAAATAAAACAATATGCATATTATCCTCGGTAATCTAC
TTCACATACTTTCTTGTCATCAATGAAAGCTTTAACTAGTGCTTTATTAACTTCAGCATATTGAGTAGTAGCCCATTGAACGTCATCTTTCATCATT
GTGGTTTCTTTAGTAAACATGCTTTCATTCTTAAACCACCCCATAAAACTTACCTTTACCAATTCCATAACAATCTCCTCATTTAACCAACAAGACT
ACTATACCATAGTCTTGTCAGCTTGTAAACTAAAATTTTAATTCATTTGCCAAAGCATCTAACTGAGCTCGAGTCGATTCGTTCTTTGATAGCGAT
TCTGCTCAGCTTGTATCTGTTGTGAACCTGCTACCTCACTCACTTCAGTTGGAGTAGAATCTTGTTCAATTTCTACCCATTTCTGATTTCCTTTTG
AACACCCATCAAAAACTTATTCCATTTATTCTTTATCACCATATCGTGATTTGATTTGCTTAATAAGTTGTTGTTCAGCAGCTGCTAACTCCTCGGTT
TCAATGACCGCAAGCATAAATCAGCTGTTGCTGGAAGACCGGCAGATTCTGCAATATCGCTCATGTTAACATCAGAAGAATCCCAAGCTTGTTTAC
CAACCTGTGCTGCAGTCCAAAGAACAGTTTCGGTTTCAACAGCAAGAGCACGTAATTCCTCTGCAATGGCTTTAACAGTTGTGTAACTATTTTCTGA
GTAAACTCTAATGCGGCAAGATTTACAAATACCCAGATAGTCGACAATAATGATTGTTGGAACAAAATTCTTCTTGAGCTTTAATTCGTTTAAAAGC
GATCGAAATGTATTAGCATCTGCTCCACCAGTAGGATACTGTTTAACGATTAAACGACCGAGAGTAGATTTCTCACGCCATTTTTCCATTTTTCCTT
TATACTCAGCGTAAGAAATATGCCCATCATCAATGTCATCAAGAGAAACATCAAGCATATTAGCATCAATACGTTTAGCGCAGACTTCTTCTGCCAT
TTCCATGGAAATGTAAAGAACATTATGTCCGAGCTGTAAATAATCTGCTGCCAATGAACACAGACCTAATGACTTACCAACGTTAACGCCAGCCATT
AAAACGTTCAGCGTTCCAGTTTCAGCTCCGCCTTTAGTAATTTTGTTTAGAATTCTGAGTTTAAATGGAACCTTACGAGCTTTATTCATATAAGATA
GCCAACGTGCTTCGTAGTCATCCATCCAATCATGACCAACGTAACTATCAAATGAAATTGATAATGCTTGGCGCATGATGTCAGGAATAGCACCAAC
ATCCGGCATTTTCTTATTTCGTTTTCCGGAGGAAGCTCAGCATTAGTTTGAATTTCAATTATTTTAGATGTGGCGTTAAACATCGCCCTTTGCTGA
ACATATTTTTCTGTTTCTTTTACTAACCAGCTGTGGTCTTCCGGAGAATCAGCCAGTTTTGAAATAAGTGTTTTTACACCAGAATATTCTGTTTCAG
TAAATGAACTATTTTCTAATGCAACATTTAACGCATTAATAGATGGAACGCTATGATACTCGTTGACATGAGATTTAATTAATTTGAATGTATTTTT
AGCTGGACCACTTTCAAAATATTCTGAATCCATATATGGCCAAACTTTTGAAAAATAAGCTTGATCAAATATAAGATGAGAAAGAATAATTTCTACC
ACACTTACTCCTTAAAAGAATTTAAACTTTTTCTTTGACCTTTTATTAAATGCATCTTGTAGTTGCATTGTAATACATTTTCTACATGAGGAGCTA
ACTCAGCTTTTCTTCTTGGTCAAGAACAGCAAAGTCCATTACAACCTTTCCATCAACCCAATCCAGTTTAGTTACATACACTATATGTGTAGAACC
ATCTTCTAGTTTAATGACAATCTCCTGGATAACATTTTCCATAGCGGATTTAATTATCTTAAGAGATTCATTAAAAAGACGTTCTTTTCTTTCTTCT
TCCCCCTCCGAAGAGGGGATTCATCGATAATTTCTAGATCTAAATCTAAATCATCTTTATTCATTAAATTCTTCCATATCACTTAACTGCTCGAGG
TCAGTTTCTAAATCAGCAGCTGATTTACTTTTACTTTCTGGAGATTTAAATTTTTCAACCTTTGAGTTAATCAATTCATCGACTTCAGCTTCAACAA
TTTCATTACTATCAATAGCACCTAACTGATAAGCACGTTTAATAGCATCTCGGAATGGTTGATGCTTAAATAAAGGACCCCAGAATGTAGTGCAGTT
GGTATCTTTTGCACGCCAAGATTTTCTTCGCGAATCATCTCACCGGTTTCTTCGTCAAGAAATTCACGAGCATACCAGCCATTTTAGGTTTTACC
ACAAATCCTAATTCAAGAGCCATATCTAACAATCCAGAATAAGGATCGATGCCACCGTCAAATTTAACATCAATAAAGAATTTACTTTTTTCTTTAA
```

Figure 11(J)

```
CGGTACGAGATTTTTCTACATTTAGAACAAATTGATACCCCTGAAGATCAGAACCATCTTTAATCTGGCGCTTACCGATAATGAATACAGTATCAGC
CGAATACATTACGCCTGTACCACCTGTCATCACGGTTTTACTAAACATTTCAATTGTTTCAATTGTATGGTTAACCGCAACACATGGAATATTTTA
ATGCTAAAGTAAGGAGTAACAATACGGAATAATGACTTCAGTGATTTAGCACGAGTCATATCTGCCACAGATTTTTCATTCAAGGCATCTTCCGTTT
CTTTCTTAGAAGCCATATTACCGATTGAGTCGATGAATACAATAACCTTTTCACCACGCTCAATAGCTTCAAGCTGGTTCACCATATCAATTTTCAG
TTGTTCAACTGACTGAATTGGCGTATGAATTACACGTTCCGGGTCAACTCCCATGGATCGCAAATAAGCTGGAGTAATACCAAATTCGCTATCATAG
AATAGACAAACCGCGTCAGGATATTTGTTCAAATATGCCGCAACCATAGTCAAAGACATATTTGATTTAAAGTGTTTAGAAGGCCCTGCGAAAATAG
TTAAACCAGACTGCATACCGCCATCAATTGCACCAGAAATAGCAATATTAAGCATTGGGATTTTTGTACGGATTACATCCTTTTCATTAAAGAATTT
AGATGTAGTCAGTTCAGCAGTCATTTTAGAAGTGGAAGCTTTAATCAAACGGGATTTTAAATCTGCAATAGACATTCATTTTTTCCATAGGCATCAT
TATATTTTCCTCACTGGTTAAAGATAGAGTAATTATAACACAATAAATTTAGGCATTAATCAACTGCTATTGGATGAATAGCATTAAACTTATGAAA
TGCTTCTGATTTTTCTTTGCGCGAAACACACATGCGAAGAACCCTTTAATGGCTCGTCTTCTTCACCCAACGATTTTCGTTTTTCAATATTAGAAGTT
TTCCAACGAGCTTGCTCTGGAAACTCTCTATTGATTTGCTCAAGAGCTCTATTATGTTTTGAATTACTACGAATTGAACTGCACCCGCCCGGAGCCT
GTGCTTTTCCAGATACAACCAGATATTTGAACAAGGCCAAATGCGGATAACCTTGATTAATTAAATTGAGAAATGCATACATATCTTCGCATAAATC
AATTTTTTCCATACCCAATTTGTTCTGTTGTAAGTTTTCCAAGGTCATACCAAGTATTCGTGAATCCATATGAATTTTCACGATAATTACCCCAAGAT
GAAGTAATTTTAAAAATAGGTAGACGAGCCATGGCCATGATAATAACCGCAATCCATGGCATCTTTAACGTATTGAATCAATTCATAGAACTGTTCAC
GAGTTAATTGATTAATTTTATCTACACAGCGACGATCATCTTTCTTTCGCATTGAACTCATACGAATAGTAGTATCATCATCAATCATCCAAATTCG
TTGACCTGCATACATATCAGTAATTGCTTTACGAGTACCAGCAATTCCGTTAACATCATCAGGAATAGTTATAATTTTAGCTCTAGACCCGTAAGCG
TCATAATAAGCTTTTTCTTCGTGTTCACGTACTACAATATGCGGTTCATAATCAGATGGAAACATATCAAGGGCAGAAACTGCCCCTACGCGTTGAT
AGCTTGGAATTACGAATTGAATCATTTCCACTCACCGTTATAATCTTTTTTCGCAATATGTGTTTCACCAGTTTTCCACCAATGGTCAACCAAATAA
AAATGACGGGAATACACATGAAGGCTCCCGACATTCCATATAATGGAACCTGCTTATACTGACGAGTTGAATCACCTGCATTCAAATCAGATACTA
ATTTATCTAATACGTATTTTTGCCATGCATAATCATTACGGAATCCGAAGACCACGTCATTTGAACGCATGCTTACTACTGCATTGACTTTCTTATC
ACGAATCAGGTACTGTACTGTATTCGTACACATGAAATCTGACATACATCTTTATTGTAGTCAAATTGCATGGATGGACGAGTATAAATCATGATA
CCACGTCGAGAATCAGGATTTTGACCAAGTTCAGCTAAACACATATCATCTGGGCATAGTTATCTTCTGACCAGATAGCCCAACCATAATTCGAGT
TAATTTCGCCTTTAGAAGATGCTACCTGCTGCCAAATCTTTGGTGTTTCACCTGGAATATCTTTAACAAACAAGCTCTTAGATTTATACCATTCAAG
TTCACGCTGAATGTATTCATCATTAAGAGCGCCAAAAATAAACGGTTCATCTGCTACAAATGATGCGCCAATAATTTCAATAGTTTTAACACCAGTT
TTATCAACTACGAAATCTTTTTCTTTTAATGCAAGCCCCAAATGAAGACGGATTTCTTCAACTGTCATAGAGTCACTAATCATTTAAACCTCAATTG
ATACATTCATATTTAACTTGTAACAGTAATAAACCCAACCTAAAATAATAGTTGGAATCATAAGAGGAACCGTTACACTATAGTATATATACTTATTA
TAATCATCAAGATTAAAAGCAACACTGCTATAATTTTGCTTTTCATTCCTTCTCTCTGATGATAATTACCTGATTTGGTGTGCAGACTTTTTAGTT
TCACCCGCAATTGACCAAATAAATGTAATAAACCAACCAATAATTGACCAGTTAAACAGTAAAGACGTGAAAAAGATTCCTACTGTTGATTTTGACC
CACGCATCAAGGCGATGAACCATGGAAGCATGTATATAATAATAGCCAACACACCTGAAACTAAAACCATAAAAATTGAACCTGCTACTAAAGTTTC
CATGTTTTCCTCACTTAGTCAAATTTTTTACACATGAATTATAAGAATTCACTACATACTCCATCGGAGCATTTTTACCAGTACGCCATTGGTAATT
ATTAGCCCAATTAGCCCAAATTTCGGCGCAGTAGTTTTCAATTTTTTCTTCGCGTGTAATTACATCAGAATTACGATATGCTTGAGCAGATTCATCT
GGACGAATAGCTTCGTCAAAATTTGCCTGCATTTGTTCTACTGTTTGCTTTGGAGCTTCTTTATAACACTTGACATTAGGATTATAAAACTTGCTTG
AACAGTTTACAATTTTTCCTACATCAGACTGATTTACTACCGGTCCTTGAGCTACACAACCAGTAAGACCTAATGCAATAACCAAAATAGCGATTTT
CATAATAATTTCCTCAAATGCAAGTAGTAATTACTCCAGTAGTGCTTATGCAGGTATTACCCATTTGCACACCTAAAGATCCATTTGTATTCACATG
AAGATTATCATCAATTTTAACTGATATTTTACCATTAGTGTGAATAACGGTGCTAGATTTAATCACAGGTTGAGTATCATTTTCAACACTAACAAAT
GGAACTGCTACTAATGCAACTAAACAAACTGCTAAGCATCCCATAACAATTTTCATTTTATTCTCCAAATCTGTATCAGTAGTTGATAGTTGTATAG
TACCACAGAGGAACAGTCTTGTAAACAGTTTTGTGAAAATTTTTTAGGGAATTCTAAAGGTCCAAAATCATCTGTTTTTCATAAGTATAGATTTATA
TTACTTGTATGAAAAGGGACCCGGAGGTCCCTAGATTTATTCTATCAGCCAAACAGGAAGTCTAACGAAGCTTTTTCTTCATAGTCCATACCAGCC
GATTCACACATGCCCGCAAGCGGTTTAACAAACGATTTTTGGAACAAAGTTGAGTAGTCAATCCAAGACAGTACGTCAGAACGAATTTCTTTTGGAA
GTTCTGTACCCGACGGCCAAGCAATGCATTTGTCACCAAATGGATTTCCTTCACGCAATGGAAGAACCATTACTTTATTTCCATCCAAAATTGGAGC
TACACCTAAACCGCTAACAGCTCGACGATAAGTTAGCACACCAGGAATATGGAACGGGCATTTAAATCCTGGCCAACCTTTATCATCATATTTCGCT
ATATCGTTCGCAGTTTTTACTTCAGCAATAACTTTATAGTCAAGTTGACGATATCTTTCTCGAAGTTCTTGTAATATTCTTGGACAGACTCTTCAC
CTTCTTGAAGAATACGACGAATACTTTCTTCGAGAGCTTCTTGTACTGCTTTTGGTGTTGAACTCTGCTGAGTTTCCATACCCATGATTTTTAGATG
TGGTTCAGCAAATCGCTTATCTTCCATATCATAAACGTTCAGAGCATAACGTTTTTTCGCTTTCCAAAATCCACCAACACCCTTTGAACCAAGCGGA
GGACAAGAAATAGCTTCACGGTCCATATGCATCAGATGCTCGCGATTATTCATATAATCACATAACTCACGATATGCAACATCAATCATAGGTTCCA
TCTTTTTCTTACCGAACTGATTCATGAATTCAACTAAATCATTTTGTTCTTTAAAGCGGTCAAGACCTACTTTTTCAATAACTTTATCTACACAAAC
ATATACCGAATCAGTATCACCTGCTGCGATGAAATCTTCACCATTAGTTCCACATACTTTATTNGATATTCATTAATTTTACGAGCAATCCACTGA
ATACCAACTTGGCCGAAATTGTGATAGCAGTAGCATTTCGCAAATCATAGTAACGAAAATGAATATTACCAAGAGCACCGTAAAGACTGTTAATAA
GAATTTTACGGTTCAGCTGATTTGTGTTAGCAAGTGTAGCTGCTTTTTCACATTCTTCAATCAAACTATTGAGAACAGATTCGGTGTAATTCGATAG
TTCATTTAAGAAATCATCACTGAACTTAACATATCGTTCAACTTCAGGTTTAGTTGAACAAGACCCTGCGCCTTTCATAATAATCTTTTTAATAGCT
TCGGCATTCATTTCTTCAGCGAACATTTTCTTTTTCCAATCTTTTACGCTGGAAAAATACTTTAGCGATTTCCTTTGGAATGATACCTTCTTGATGCT
TATCATACATCCATCCATTCGGAGAACAAGAATATTCATCACTCGGTTTAGGAGCTGTTCCTGCAATATATTCATGAATTGGATGAACTTTAAACTG
CCCACGAATAGTCTCAGGACTAATGTTAACCTGACGAATAATGCTCGGATACAGAGACGTCAAGTCAAAACTCATAATATATCGACGAGCAATTGGT
TTAGGTTCAAACACAAATGCACCCGGAAAACTCTGTTTAACGTGCGAACCCTGTTGAGGAATAACCTTATGTTCACCTTTCAATGAGTTAAAAATAA
TGGCATCCCAGGTTTAATAGGACTCATTACACCAGAAAAAGGCATTTTAGCGTAATAAGACATACTTAAAACTAGATCGATAAACCCGCGAATTTT
ATCAATTGCTTGAACTGATTCTACGTCAATGATGTTATAACTAATGTATCGTTGATGATTAGTCTCACGAAGTTTATTAATAGGACCGTCGTATGGT
AATTTACCTTTTTGGTTTCATGCTGAGCAACTGATTCCAAAGAGAATGACGGCAAATTAGTAAATGCGAATTTCTTATACAAATCTAAATAATCAA
GAATAGATACGCCATCAATAGAATAAATTTCTTTGCTACCGTACATATTTTGGATAAGTTTAGATTTTACTCGACCGATTGGAGAGAAGCGTTTCAT
ACTACGTTCACCGAGAACCATTTTAACGCGATTCATGATATACGGAACGTCAAATCCCTCAATATTCCAACCAGTAAAAATAGCAGGTCGTTTCTGT
TCCCAAAGATTAATATATTCCATGACATACACGCTCATTATCAAATGGCATATAAATTACTCGGTCAAGAATTTCTTGAGGAACTTCATCACCAC
CTTCACAGTCAAGCTTAGCAGCTAACTTTGCATCCCATTTTGATACTGAACCATACATTGAATTCAAAAGGTCGAAAACATAAAAACGATCGTCAAT
TGAATCATAATGAGTCGATAGCATCAATTTCATATTCTGCTTTCATTGGGTCAGGAAATTTATCACCAGTAACCTCAATGTCACAGTTAGCTACACGA
ACAAATTTTCGGTCATAAACAATTTCTGAACCATATGTATCACTGATATAAGCGAGTTTAAAATCGTTCATACCGAGAGCTTCGAGACCGATGTCTT
CCATTCTCTTCATCCAATCTCGAGCATCTTTCATTGATGGAAATTTTTGAGGAGCGCAGTTTTTACCATAGATGTCTTTGTACTTTGACTCTTCCTT
ACAATGCCTAAACATAGTTGGAAGATATTCTACTTCACGAGTACGTTCCTTTCCGTTTTCATCAATATAACGTTCAACAATGTTATTTCCGACTGTT
TCGATAGAGATATAAAATTCTTTCATAGATATTCCTTAGTTTATAGCCCGAGTTATTAGGCTCTTGATATATTATACTCCAAATAAGGGGCCGAAGC
```

```
TTGTCTACTTCAGTTACTATAACACGTACTGATAGATTTGTAAAATCTTTATAGTCAATTTTTCCTTTAAATGGATAATGAATTCTACGATGCCAGG
TAGTATTGTTTGGAATAAATTCCATTCGTTCTGTTTCTGTATCAAACATCCAGAACCCACGAGGGTCATTCTCGTCACCGGCAGTTAGTGTCCATGG
TGTCCCAATATATCTGACATTAGCAGCCTCAGAAATAGTATGGAAGTGACCAGACCACACTTCTTTATAAGTCTTAAGGAAATCAGGTTCAAGACCG
TGAGATTTCATTCCTTTATAAAAATAAAATCCATTCAGTTCCCAGTGACCAACACAAAAAGAAGCAGAAGAAGTTTTTATGTGCTCGAGAATTTCAC
CAGTATTTTCTTCACACATCCAAGGAATCAAATCAATCAAACACCCGTCAAAATCTACTGTAGTAGGCTTATCATATACTTTAACATTAGGATATTT
AGCCAAAAGCTCAGTAGAGGCATTTGGATGCATTACATTTTTGTAGTGGAGATCGTGATTTCCTACAATAGTATGTAGGGTAATACCAGCATCATCA
AGCATTTGAACTATTTCACGAGCAAACTCCATAGTTTTATGCGTGATCGCTTTTCGCACATCAAAAATATCACCGTATTGAATCCATACCGTAATTC
CATTTTTCTTAGAATATTCTATCGCTTGCTTAATTCCATCAATTTGAATACCGCGAATCCACTCATCATCAGCTTTAACGCCTAAATGCCAATCACC
TAAATTTAAAATTTTCATATATCAAGAACCGTCATTGAAATGCAAAATAAAATTATTGAAATAAACCCATCTGGTGTGCTAAAGAAACCAATCCAGC
ATGCTCTAGTGAATAGATAAAATGCAAGAAAAAGTATCACATATCCAAGAAATATCATTATATCAAACTCCGTATAAAGCTAAAGGGCCGAAGCCCT
TTATTTTGTAATAATGTCAAACTGTTCTTTAAAGCAGAAGCTTGAATCTTGATGCTGATACAAAAATTCATAAGCTTTTTCGCGTTCGCGGTCATAA
AGAGCTCGGTCAGATGACAGTTCTTTAATACGTTCAAACGTTGATTCCATATCATTTTCATCAAACCAAATGATACCGCTATCATGCGAGGTCAAAG
GAGTATTATCAACACGGAATTTTAATTTTTCGCCAGTAGATTTCCAAAATACCGGAATTGTTCCACATGCACCAAGCTCGAGATGAGTATATTCTAA
AGAACGTTGTAGATATTTTTGTCCAACTTACTCAGCTGATAACCAAATCCGGATTTACTCATGCGTTCAAGCATTTCGCTATTTACATAACGGTCA
AGAATTTGCGTTGGCAAATTAGGAGCAATTTTAATTTGGTCTACTTGATGAAGACGATAATACTCGTATGGAATTCCTTTTTCTTTAATAGGAATGA
ACGCTGGAGAACGTTCCAGACCTTCCATAATAGTACTTAGTCCTGCAGGTTTAAGATGTTTTTCATGAAAATCAAACATCTGATAAAAACCTTTCCA
TGTAGTCGTACGACCAATCCAACGGTTGATATTCATGTTAATTTCAGAAACATCTTTCCAGTAGGTTGACCGAACCTTCGCAATATCCATAGGAGGC
TGAAAGTTATATACTGTCGGTGCTTCTTCAATATCATCAAACAGAGAAACTGTTTCAGGATACCATTCTTTCATCAGAACTTTATTAAAATCACCAT
TATCAGAATGGCTAAAAATAACATCAGCTCGACGAACAGTTTCTTCTAATCCCAAATTTCGGCGCAAAGAAAGAGAAGAATGGTCATGTTGATAAAC
TACAACACGAACAGAAGGTTTAATGTTATCAATAATTTTTTTATAGTTATTAATAGTGTCTTCTTCAACCGAAGTAGCAGGAACTGAATTGATAATT
AGAATATCACAATCATTTACCAGCTTAAGTGTTTTATCATATTCTTTTGCCAATAAAACCGGAATTGAAAATGATTTATAATCATGCGCCAATTAC
GAGTAAATGATTTATCTTTAGCATAAACCAAAGTTACTTCATGACCATTCTTAATAAACCAATCACGTTGCTCAAGAGAAAATTTAGTTACACCACA
ACCTTCAAGACCTCGAGCCATAAAAATACATACTTTCATTTAATATCCTCTTTGTTTTGGTTTATTTTACCAAAAATTTATAAAGCAATATAGGAGC
CGAAGCTCCTATCCACATAATACGCCATACAGAGGCTCGTTAGAACTTTTAAATTTTATGCGCTTATATTTTATAGTTCCTTCTGCTTTAGCTTTAT
CATGAGACTCTTTAAAGCGTCTCATCATTTCCTCTTTAGAGGAACGAATTTTATTTATAATCTATTTCAGAAGTCTGGGTGTTCATCTTTCACAGTTG
CCACCATTTTTTGACTTGATAGGAATCAACCCACACTTTCATATTAGGGTCTGCTCTTACAATAGGAGGATTAACTTCTTTAATTGAACTATCATGG
TATTCTTTTTCAGAAATTTTCACGCAAAGATGACCATTCAAAGATTCAGTAAATCCTGCATTAATTTTAAGACGCTTGAATTTTACGTGTGTAAGCA
TCAATCATATCCTCAATCTGCGATCTAGTAGTCTTCCAAAGAATACTGATGAGTTCATCGTTATATGGCTGTTTTAGAATATCCCGACTTTTCTTGA
TAGCATATTCGTATTGAGCAAAATTATTGTTTTCAGCTGCAGTCTGAGCGTGCTTATAAAGACGATTCAGTTCGCGTTTGTTTTAGACAATAACTT
ATTTGCTTTTCTTTCTGCTTCAAGACGGTTCTTTTCTTCAATAGAAGAAAATAAGCTTTTCCACTTTCATCATTAATTTCGGGTTTATCAGTCATATTA
TTTCTCTAATATAAAATAAAAATCATCATCTGTTAAATGATACCGATAGTTTAATTCTACACCATTAGATTTAAAAGCGGTATCATACGGATTTTCT
GGATCAATATCAATGTCAAGAGCTAAAACTTCCCTGAGATACATTTTAAGTAAATAGGGAATAGCTTCAACTTCAGGTATTCTTCCAAGAATCCGG
AGAGGTTAATCGTTAGCCTCATATAAAAAATCCAAACTAGGAGAATCGTCTACAACACTTTTCTTTTCAGCCCCCGGTGTTCTATAGGTTGATTCTT
CGTAATGCGTCATTTTATCGTAGATGTCTTGAATAAAAGTTTCATCTACTAACGCAACCATATCGTCGTCACGGCTGTCATAGACATTGTGAACGAA
ATAACTATATTTCTTTGCAACTTCCTTACGTTCTTTTTTTAATACGTTGGACGAATGCATTAAAACAAGCTTGAGTTATATATGCATGTGGGTTTTTA
TATTTCGTTTCATCAAAATTATGAAGCCCCTTAATAGAAGCTTCTATCACATCTGCAATCATTTCTTGTTTCCAAGACTGGGTGTATCCTGAAAAGT
TGAAACGTTTAGATAAGCCTTCTGCAATAAGCATAATGGCTAATCCGATAGTATCATTCTGACGAACTACTTTATTTGGGTCTTTATTATTTGCTAA
TTCTGTTTTCCAATCAATAATAGCTTGTAAAAGCTCTTTATTGTTTACGTAATTATATTTAGGCTTAGTTTCTGACATTTTCACCTCTTAGCTCAAT
TCATAGATCTATTATATCATAATATTTGAAGATCTATCTTAAAGCATAGAGGATATCAGTTATCTAAGTAAACAATATGCTTGGAATACTTTCTCCA
TCATCTTTTTAAATTCATGAAATATCTATATAATGACTAGTTAAATCAGCATGATATAAAAAGTCTAAAACTTTTCATGTGTGCTAACGTATTCACT
TTCATTTAATTCAGAAACATGACTTTCCCAATATCCAACACCAGTCTTATTTGGGAAAATGAAATTTTCATGTATTGGTCAACATAGAAAATGCCA
TAATTTTCAATAGTAATAGAAATATTAATAAATTTCATCACATTCATCAACTTAGCCGCTTCAAGAGCTGCATCTAGTGAATCAAATTGATCAACATA
TTCAATCAATTCGCCGTAATTGGCATATAACCACCATTGGCTAAATTCATACTCAAGGATGAATCCGTTTCCTTCAATTTGAGTTAAACCAATGCCA
TTTGTATTTACTTCATACCCAGCAAGACGTAAATCGTTAATAAGAGCTTCGTTCATAATTATACCTTAGTAATTTTCAGGTCTGCAAATTTTTCTT
GCGTTGATTTTTCATACGACGAATAGTTTTATCGGAAATTTCATGCTTTTGATAAGCTTTAGATTCTACACCAAAAGCTTTAACATCAAATTCTGAC
AAGATATATTGAACCAACAATTCACGGACAGTATTGCGTCCAATCTTCTGATCATTCTGTTTCATCGTCTGATGAAGCTCTTTTTCCCATTTATCCA
AAATTTGAGGAGTTACAATATCGCCTTTTTCTAGCAGAGAAACTACTTTATCATATGCGTAAGAATTGATGGCGTTTTTAATTTGAATAGTCATACA
TTATCCTCAATTGCATTAAAATTTTATTATCCAAAAAGGGCCGAAGCCCTTAGCTAAACTTTTTGGCGCCCTTCCAGCCTTCGTACATCATTGCGAC
TGACAATGACAAGGCTCCTTCGCATGCTGCATACTTATTATTCCAGAACCAATTTAGAAAAACTTCGTCCTCAATACCATTGTGTTTCATGTTCTGG
AAAAATTTGGCGCGTTCTTCACGAAGCTTTTGCGATAACATAGATTCAGGATTCATTTAAATTTTCCAATTACCGTTTTCATCAATGAATTTAATCC
AGTCATTTACTGACCACTTAGTTGTATCGCCTTTTGGAGTAGCATTTAAAGTATATAGCCCTTGCTTAAAAAGCATTCGTTTGATATTCATATTTTC
CTCAGCTGTAACGATAACACTCGTTTGATTTGCGTTTAGCAACTCGTTGAGAAGTATTATAATCAAATCATCGTCAATGTAAACTGATTTTTTCAA
CTTTCTTACTTCACCACGTAATTGACGATTCAATTCATTCTTAACCTCTGAATCAACACCTCGCATACGTCGCCATTTATCTGAGCGAAAAATGTTT
TCAACCATATCTTTATGACTTACACCATCAGGAGCTTTACGCCTTTCCGAAATAGTCATAATCACGCACCTTTTAAGTCTTTACGACGATACGTTTAC
CCATGGAGTTTAATTTCCTTAGCAACTGAACTAAATGCAGCACGATCGCAAATCATGCGTTTATGTAACTTGAGTATAATATAGCAAACTTCAAAAC
TATTTACATGAGTAACACGAACAGCATTACCATTAATGAGATAATACTGTCCCTTTTAATTTCTTTATCAACCATAACCATATCAATTCCTCAAAG
GTAATTCATATGTTAATAATACCACAGTTTGAGCTCGTTGTAAACAACTTTGTGAAAATTATTTTAGGGAATGATAAGAAGGGAACGATAGCTTAGA
ATGGTAATATACAGAATGTAAGAAAGAAAGGCCCAGAGGGCCCGCCTTAGTCTTCTATGATATCTCTATCATATCCAAGTGAAATGAGAGTTTCTTT
GAAGTGTTTAATGTTCTTTTGTCTAGAATCATTGATGAAAATGACTGGATAACGAATGTTAAGAGATGTGAATCCAGCGCGTTTAGCAAGAGATACA
ATCAGTGGACGATCATACTCAATCTTACCATTATTTGTAAGAACTTTATAGAAAGTAAAAGGAGCATTAAGCTCCTTTAGAAGTTTTGTAACTGATT
GACATCCAGGACAACGACCTACTTCATCTGGAATTCCATAGACTTCAATCTTATTCTTTAAGTTCGAGTTTTGTTCCACGAGAAATAATTCCTTGAT
AAGCCCAGTATGGCGGGTTAACAGAATCATCGCCAGAATTTTCTTCAGGAAAATAAACCTGGATAACAAATCCAGATGCATCAAAGGTAAAATAAAC
CGTAGGTAATTCACCTAACAATTCAGCGCGGTTATTAATTTCTTCAAGTTCTCGTTCTCGTCCAGCCCAAAAACTAGGATTTAGACTACATTCATAG
AAATAATAGTCATTACCGAACATATCAAAACCCTTCCAACTCTCTACCACATATCGCTCAAAACTAATCATAATTAGGCCTTTTATCAAGAACAGC
ATTCAGTTTGTTAGTAATTTTATCCAGACGCTCATTGAACTCGCTAGAAGATAAGCCTTTTTCTGGAGAAATTAAGCTAATCACGAAAAATATAGCA
ATAAAAGGAATAAGAAAAATAGCACCAACTGCCATAAACAAAAAGAACGTTACAGTTGTAAGAAAATCAGCTAAACCCTTTACGAAATTTATACATAT
```

Figure 11(M)

```
TTTACCCTTAATTCTAAGACCAGGCATTGATAAGCACTAAACTATATTGCGAATAAAATTCTGGACCAAAATGAAAAATCATATCATTTATAGTATC
CATAATGTAATTCAATTTACGCCAGAATGCGTTCGCACAGCCGCCAGCCGGTCACTCCGTTGATGGTTACTCGGAACAGCAGGGAGCCGTCGGGGTT
GATCAGGCGCTCGTCGATAATTTTGTTGCCGTTCCACAGGGTCCCTGTTACAGTGATCTTTTTGCCGTCGAACACGGCGATGCCTTCATACGGCCGT
CCGAAATAGTCGATCATGTTCGGCGTAACCCCGTCGATTACCAGTGTGCCATAGTGCAGGATCACCTTAAAGTGATGATCATCCACAGGGTACACCA
CCTTAAAAATTTTTTCGATCTGGCCCATTTGGTCGCCGCTCAGACCTTCATACGGGATGATGACATGGATGTCGATCTTCAGCCCATTTTCACCGCT
CAGGACAATCCTTTGGATCGGAGTTACGGACACCCCGAGATTCTGAAACAAACTGGACACACCTCCCTGTTCAAGGACTTGGTCCAGGTTGTAGCCG
GCTGTCTGTCGCCAGTCCCCAACGAAATCTTCGAGTGTGAAGACCATTGTATATCTCCTCTTTAATCATGTTTCCACACTCCGTCGGTATTTGACCA
AAGTCGCTGATTATCTGATCCTCGCCACAGCTTTTTGGTCGGAAGATTTTTCTCATACTTCCCATCAATAATAACATCAACATATTTAAGCATTTCT
AGTTGTTTAATATCTTCAAACTTATATCCTGTCCACAACCAAATGCTTTTATTGGGATAAAGATTTTTAATAGTTTGAACCACAGAGTGAATCACGT
CTCTGTTATCAGGATAGAGAGGGTCACCTCCGGTTATAGTCAATCCTTCTATATAATCATTATTCAAACATTCAATTAATTGTTCTAGTGTTTCACC
AGTGAATGGAACACCATTTCTAGCATTCCATGTTGATTTATTATAACACCCTTCACATTTATGCAAACAACCTGTAACGAAAAGAACGGTCCTGCAG
CCAGGACCATTAACAAAATCGCAAGGATAAAATCTATCATAATTCATTGGTGCTTAACCCTATGCATGATTTCTTTATTTTTGCCGAGATTAAATCC
GCGTTCGTTCGGATTTCCCAAATAGCCACATGTTCTTCTTATTGTGTTCATCTTTTTAGGATCAGTTTCTCCACAAATAGAACAAACAAATCCGTTT
TCAGTAGGAGTCATTTCATGGGTACTTCCACATGTAAAACATTTATCTACTGGCATATTAACACCAAAATAATCTAAATGTTGTGCAGCATAATCCC
AGACAGCCTCAAGACCTTTTAGGTTATTTTTCATATCAGGAAGTTCAACATAAGAAATGTGACCACCTGTCGCAATGAAATGATATGGGGCTTCGCG
AGAAATCTTTTCAAACGGAGTAATATTTTCTTCTACTGAAACATGGAAACTGTTAGTGTACCATCCTTTATCGGTAACATCTTTTACACTTCCATAT
TTTTCTGTATCAAGTTTACAGAAGCGATAACAAAGGTTTTCAGCAGGAGTCGAATACAAACTAAAAGCAAATCCGGTTCTTTCAGTCCACTGCTTAA
GATGAGCATTCATTTTAGTTAAAATTTCTTGTCCAATATCACGACCGACAAGAATATTCAATTCATGAATACCAATGTATCCTAAAGCACTGAACT
TCTACCGTTTTTAAATAACTCAATTATGTCGTCATCAGGTTTAAGACGAACCCCGAATGCACCTTCTTGGTAAAGAATAGGAGCAACAGTCGCTTTA
ACTCCTTTTAAGGAACTAATTCTACACATCAAAGCTTCAAAACATAAATCCATTCGCTCATTGAACAATTCAGTAAATTTCTGTTCATTGAACTGTG
TTCCAATATAAGAATCCAACGCAATACGAGGAAGATTCAGTGTTACAACACCAAGATTATTACGTCCATCAAGAATTTCATTACCGGTTGAATCTTT
CCACGCACTCAAGAAACTGCGGCAACCCATTGGAGAAACAGGAATAGATGAGCCGGTGATAGCTTTATTGTTCTTAGCTGAAATAATATCAGGATAC
ATCCTTTTGCTTGCACACTCTAGAGCAAGCTGCTTAATATCATAGTTCGGATCGTCTTTATAAAGATTAACACCTTCTTCAACGAACATAACAAGCT
TAGGGAAAATAGGAGTTATCCCATCACGACCGAGACCTTTAATACGATTTTTCAGAATTGCTTTCTGAATCATTCGTTCAGTCCAGTCAGTTCCCGT
ACCAAATGTAATTGTTACAAAAGGAGTCTGTCCGTTTGAACTAAAGAGAGTATTTACTTCATATTCATAAGCTTGGAATGCATCGTATACATCTTTT
TCTGTTTTAGATTGAGCATAATTTAACGCATCAGCGATTTGCCATTTTTCTGCATCCTCAATATGTTTTGCATAGGTGCGTTTAACATAAGGAGAAA
GTACTTTATCTACATTCGCAAAAGTCGTTCCGCCGTATTGGTGAGAAGCAACTTGCGCAGTAATTTGTGCCATAATTGCAGTAGCAACTCCAATTGA
TTTAGGAGTTTCAATCTGTGCATTACCAAGCTTAAATCCGTTTTCAAGCATTCCTTTTAAATCTACTAAACAACAATTAGTAAATGGAAGAGCAGGG
GAATAATCAATATCATGGAAATGAATAATTCCGCTTTCATGCGCTTTCATAATAAAAGACGGGACCATATTTTTGGCAATGTGTTTAGACACAATAC
CAGCCATAAAGGTCCCGTTGAGTTGGAAAAACACGAGAATCTTTATTAGCATTCTCGTTTAAAAGGTCTTTATTAGTTTTTATGAATCAATCCTTCAAT
TTCTTTTTCAATTGTCATTTTAAACTCTTTCTAAGCTGCTTCTTAAATGAAGCTATTAATTGTGTTTTAGTGTCAGATTCATTATATTCAAATCCTC
TTTGAAGCATCTCAGCCATCATTTCCTCTTTTCCTAAACGAGAAAATTCCTTTGATTTATCTCCAACAAAGTTAGGGTGAATATTATTTTGGGTGTA
ATCGGATTTTAAATAAGTAAGTAAATTTTCTAACCATTCAAGATAATCAACACCTTGCCCCTTTAAGCCAGAACGATTAAATTTATGTTTCATTTGA
CCTTCTGCGGCATTGCAGAGATTACAAAGCAATCCACGTACCTTTCCTGCCTTTGGTCCATTTAATTCATGGTCATGATCAAGATGATTAGCTTGAA
CATCAGGATTTAGTTCTCGTTGGCAAATTAAGCATTTACCGTTTTGTGCATCATAAAATTTCTGTTTTTCTTCTTTGTATAATTTGCCAGTCAATAA
CATAATAAACCCTTACCTTAAATAGATAAGGGTATTTATTATTTTCAAGTATTGTAAAACATTCGATGCAATCGTTTATACTGTCGAATCATCTTTT
TAGTAGGACGAGAATAGGTTCCTACGCAAGTGGTCATATGAGGGTCCGTAGAATGTCCTTTAATAAAAAGTTTCCAAACCTTACCGCCATTTAACTT
TTCAGTATAAACCAATTCGGTTTTCATTAAAATGTCCTGTCAGAAAAAGAATTTTGAGTTTTTTCAAGTATTGTAAAACATTTGATGCAATCGCTTA
TATTGCCGAATCTTTTGGTCAGAAAAAGAAATTTGAGTTTCAAGCCATTCAATGTACTCTGCGGCAGCTTGCATCAGGTTACCTTCATAGCCATCGT
TATTTTCTTGCGCAGCTAATTTAGCTAATGCGTATGAAATACGTTCACCTTGAAAAGCGGCTTTAGGCTTCTGAACATCTTGGCTAGTTCTCTCTAC
AACTTCTTCAATTTCGCCATTTTCAACGGATTCAGTATTCCACAAACACCAGTATGTAATTGGCTTATCATAGATGTTAATAATCTTTCCGTCGGAA
AGTTCAATTTCAATAATTCCAGTATCAGGTTCTATATCATCTTCGCATTCTTTTGCAAGTTCACGAACTTTAAAGACAGTACCTGCACTAAGTTCCG
GCCAGTAATTACATAGCCCTGTATCAACACGATTAATTCTAAACCACTTATCTACTGTAATCATGCCCCATCTCCATATCAATTAAGTCATTTATCG
TTGGTTCATTATATACTGTTTCTTCATCAGTGTAAACCGGTTCTTCCGGCTCTGGCTCTACAGTTTCCCATCTAGCCGCCCACCAAGGTTTAACCCC
GAAGCTTATTAAGTTCTTCATAATCAATCCAGGATTCTAATCCTGATGGCAAATCAGATTCAATTTCCCAAAGAAGCTCTTCAATTTTCTGAAGACG
ATCTAGTTCTTCGGCTGGAATAGTAACCATTGACGGAGCTCGTGATACATTAATATCGTAAATCATATTTACCCCAATTTAACCATACAATCGCCGT
ATTTCCACTTAGAAATAGACTTTTCACCATTAGAATAATAAACTTCGAGTTTAGCACGATTATTTTTAATTTGAATAACCTTTGCTGTCATCAAAGT
TCCATACCCATAATAAACTGCAACTTCATCACCTACATATACCGCGCTTCCGCGGTAATCATGAATATAGTCATTTCCTTCGAGCATCATTTAAAAT
ATTCTCGCAGTTGGTCAAATCCACCAATATGACTTCCATCAGGAGCAAATACCTGGGGCATTGTTAAGCCGATTTGAGTATCACGACCTAGTTTAGT
CAGAAGCTCAGCGATTTTCTCATCATCAAAAACACCTTTTTCCGGCATAATGTTGATAAATTCAAACGGCTGTTTCTTCACAGTCAAAAGACGTTTT
GCATTATCACAATACACATTTGTGGATGTTGCTATCATAACCATATACTTTAAACATATTATTCCTTAATTCCTAGTACTTGTTAAAAGTCTCG
TCGTAATCAAGACTTTGGCCCGTTTGTTCTTTATGTTTGTATATAATATCACTTACTTCTGATAGCATATTTTATATGAACGAGTTAAAGCAGATT
TAAGCACGCTGTATCTATCAGGAAATTTACCGTGTTCATTATAATAAGCTATTGCTAATTCACGGACTGCCTTTTCAGCAGCCTCCATATATTCTTT
ACGCTTGGTCATTTTTAATCCAAAATATTATTAGGCATTGGTGAACACTCACAAGTTCTTTAAAGAACTCAGTAGAGTCAGGCAATTTAACCATTT
CCGGAGCATGCTTACTGAATTTATGTTTACATTGCAGGCATTTATATTCAAGCTCTGGTTTACGCCAGTTAATCAACTGAACTTGTTCAGTACCGCA
TTCAGGGCAATTAGGAACGTTTTTAGAAGCTCTTTCACGTCGTTCAACCATAGCCATAATAGCATCCCATGCTGGAGGTTTAAAATCTAAATCGTCG
CAGCCGTGAATCTTTCCACGCATTTCCATATCATCTTCCTCACCAGCCATAATAATTTTAATTAAACTGGAATTACTTGAAGCTGCAATGTCTTCTA
ATAAACGCTTTTCATTTCAATACCTCAATAGCATTACGTAAACCATTTGCTTTTGCATTAAGAGCTTTTAACAATTTGGTGTGTTCTGCAATTTGG
GCTTCAACTTCAGTCAAACGGGCATTGAGATATTCACGTTCTTCACTCAGATTATCAACCTTTTCTACTTTAGGCTCTTTTCAACTGTCTTATATG
TATTAGGGTTCTTCAGTTTAATTAGAATGCGTGAACTGTATAACATTGAACCATTATCTTCGGTTTCGTCATACATTTCCACTACGTCCATAATTTT
TAACATCATGCGGAGTTTATAAGACAACGAACGAATAGTTTTGTTGTGCTTATTAATTTCTTTAGCTGTAATGGCGCCAAGATTACGTGAGTAATAA
TAAGGAACCTGGATATTAATTAATACTGATGAACCACCTGGCTTGTGTGTTACTTCATCAGCAATAACCCAGTCCTTAACATGAACTGTATTTGTAC
GGTCATCGCCTGCAGTAAACAGCTTGCGAGCATGCTTAAAAAGCATATTCACTTGGTCATTGAATTGACAAGCAAATTTATCAGCAAATTTAGTTTC
AGGAATGGTAGATAACCAATCAGCCAAATGGGTCTTTTTAACATCGTTAACAATAGTAAATTCAACCAAATCAGTTATAGATGTCGCAGATTTAATG
AAGCTCGGCTTCATAAAGTTTTTAATGTTATCACGAGCTACAGTAGAAGATAACATACGAGAACGTTTAAACCATTCAAGCAAATTGCCTAACGAAT
GAGAATAAGCGTTTTGAGTATCTTTACAGATATGATTTTCCTGACCAACATATTGAAGGAAATCACGAAGAATATTATTGATTACTGCTCTGTGCCC
```

Figure 11(N)

```
GATCTGATAATTACGGTGTTTAGTAATAAGGCTGTCAAAATAATCAATATAATGTTTACGAGTTTTCATGTTCTTCTCACTTGGTTAATGATTTATA
CTCCGAGCCATCCTTGGCTTTAAATTACTTAATTAACTGTAAAGCTTGTTCAAGACGATCAAGACGATTAACGGATTCTTCCCAAATCTTTTTAGCC
TGCTCATATTCTTTCTGCGCTTTATTAGAAATTTCTAGAACTTCTTTATAAGCTTTTTCTAGTGCAATAACTTCTGGACGAATTTCTACTGGTTCAG
GCGAATCGTCAAGACATTCCATTAGTTCCTCAAGGGTAGTTTCTTCTTTAGGAGTATTCACAATTTCATCACATTTTTGTTGGTAAATTTCTTTATC
AGTCGGTGAGTACGCACACTTTACTTCACGGAGACTAACTACAATTTTATATCCTTCCCAACCGCATATATTCTTAAAAGGATAAGTATGAATATTT
TCTACTGTTTCCATACAAAGTAATGCGGTCTCTAACTGACGAGTTATATCGCTAGCAATTGAGAAAAATTTATTAATGTTCTTTTGATTAGCTTCTG
GTGTAAAAAATTCATAATTCACAAAAATAGCTGCTTTATTTTTATCAAGCTCATATTCTTTTATGATAATCATATCAGAAGCCCAAGGATGGATTTG
ACGATAATCACCATAGCATAAATTTAGAAGCTGATTTTAGAATTTGCTTCTTGAAAAGTCTAAAATTACTAATCCAACGACGAGTAAAAATATTCTCA
GGGTCTTCTTTATTATTAAGATGATAAGAATTAACATCACCGAACCAATTATATCCTACTACATCTTTAGTTCGTTTAATTTCTTTCCCAAAATTAC
CAAGAATATCCCGATTAACCAAATATGAAAGAAGACGAGACTCTTTAAAGGTTTTCTTGATAACATCTTTATCTACACGGCTAGAAATTTTACGAAT
TTCATGAATAAATTTAGTAGAAGAAACAATACTTGCATCAACACTATTGAGCCATTGATTGATAATAGAAAGAACGATATTTTGACCAAACATCGGT
ATAGCTTTATCATCAATAACGCTATTGAATGATTTGATATATTCGTTACGAGTCATAATAATCTCCTCAGTAGAAAGTAAGAACATTATACCACATC
CTTGTGGCAAAGTAAACTAGTTCAGTGCATTTAGTGCATTGTTCAGTTTAGAACGTTGCTTCGTGAGATTTTTGACTTTTTCTTGTGCTTTTTCTAG
CATCTTTTCAGCTTCTAACACTTCATTGGTCGCTTTAACGAGTTCATCATCTACTGCCTTAAGGGACTTCTCAATCGCATCCGCGTGCCATTTTTCA
ACAGGTTTAAGACTCGGATTTTCAATAGGAAGAAAATTCACTTTATTGAATTTCCATGCATCTTTATTACCTGAACTATACATCCAAAATTTAGGAT
CATTTGACGAGTAATTAGATAAATTTAAGTTATCTTGCACTTCCTGCTTTTTCTCTTGCGGGACTTCGTCCTTTCTCAAAAAATCGTATTTAAATGA
AACGATCATATCAAGTTCATATGATGTTGTATCTAACTTAAATCGTTCAAAACGAGGTAAAATCTTAGATTGAACAGCAGCAACAACATCCATATAC
TTAAATGCTTCTGTCAACTGTGATTTAAGACATTCACAAATTGAAAGAGAATTTTTAGTATTAGGCTTAAAGCTGATTCGCGCAGTTCGATTATTTT
CTTTAGATGGTCTTACTTCCATTTGAAGAGTATAACCATCAAATTTCAGATTCTTTAAGTTAATATCAGAACCTTTTAATCGACTAGCCGTAGACAA
AATTTGCTTTAATTGTTTACGGAATAAAGCAATAAATCTCCATTCAAGACGATAATGATTTGGATTATAAAATCCCGTTGATAGATCAACTTTACTT
TGACCAACGCCTTGAACAAGTAGAGGATTTTTATAATCAACGGTTTTACAGAAATCCATGAGCTGTTCACGGGCAGTCATTTGCGTAATATATCCAG
CTTTATCAAAATGCCGCAACCATTCAGCGCTATTCAATGAGTTAAAGTGAATATTACGTGTAACTTTATCAGGGTCTAAATTATTTTCACATAAAAA
TGTTATGACATTACGAGTATAACTAGCATTACGAACCATATCTTCAATTTGAGAACGAGTTTTCATAGTATTCCTTAAAATTTAAGTAAATCGATAA
TTTTAATTAAATTTTCACGCTCAGATTTAGCTTTACTGCTTAATCCAGACAATCTAAAAATTTCATCGTCATATTGTTGAATAGAAATATTTAGCTC
TTCAATTTGCTTATTAAAATAATCAATTTGTTCAGAATGTTTTCGTTACTACGAACTGGTACAGGTTTTGTAGGAAATTTAGTTAAACTGGATTCA
TCCGGGCGATAAATTAAAATGCAATTTGAACCAATCGGGCATTTAGCACCAGATGAATATTCTAACGTTCCAGCTTCTTTTAAAACTTCAAAAGCTA
AACAGAGATGATGCCCCATATTAACATAATCTGTAGAGCGAGCTCTGATATAATAATCATCGCCGCGAATACTAAATTTAAAGCATTTAAGGTCTTC
TGTATTATTGGTCTTAAAAATCATTTGTTTATCTAGACCTTTAGCTAATCGAGCGCCTAATGCTAATAATCGTCGTTGATTTTCCCACAAATCTGCG
ATCCATTTGGTCAAATGATAATTTCGGCATTAATCGACCATAAAGGTCATATCCTTTATTATAATTGCGAAGGATTTCACTCGCATTAATACGAGACA
ACGCTCCAATTTTATTAAGGGCTTTCATGATGCGATTAGATAAACCCATTCCAGACCCGTTTGTTCGTTGTAAATGTTTATCTAATCCAAACCCAAT
ATCAACTTTAAATTTATCTAAAATTTCAGCATGAACATCTCTGTCAATAACATTCAAATCCAAAGTTGGGTTAAATCTATGAAAAAATTTATCTGGC
TCTCCACGACGAAGTACAGTCCATTCATTCAATTTTTTATTAACTAAAGATTTAATTACTGCATTGACATTATTAATTACTACTGACATATTTCCTC
ACTCAATTTCAATTTTACTAAATACGCAGAATATGATGGAAAAGACTATATAAGCACCGCATACAGATTGAACTAATACCATTCCAAAGAACCAAAC
AATATTATCAAACAATGTCTGTTTTACGTCGAAAGGACGTAAACTTACAGTAATATTATCACCTTTTTCTATTGAAGAATACATCTCTGGGGAAATA
TATTCACTAAATCTATAACCATCTTTGAGTTCATATACGGCAATAAACGATAAACTAGACCCTTTTCCTTGTGTTCCTGTAATGGTATTAACTACAG
TAACATCATAATCTTTATAATGCATATAATCATTAATTGCGTAATAACCATATGCAATTACTACACATAAACAACATATCAATAAATTCAATCTTTT
AATTATCAACTGTTTCATAATAATCTCAATTAAAAGGGCTTAGAACCATTATACCATCCTTGGTATAAAGCGGTTATGCGAGTACCGTCTTTAACCG
TTCCTTCAAACTTCCGAAGAGTATTCTGGCGTTCAGCTCTTTGCTTTTTATAAGTTTCAATACGCTCTGAAATGAGAGTGTATCGTTCATTTACTGAT
TCTTTCATAAAATCAGGAATTTCACGAGAAGCTTTAATCTCGTCAAATTTATCAATAACAGCTTGCTCTTCAGCAATTAAGTTATCATACATTAAAA
TATCTTTCTTGATAAACTCAATATCTTCTTGAGTTACACGAGATAATTTAGATGCTTTATCCTTTTTGTACTGTTCGTTAGTATCACGAGACCAGTG
TAATGTACGATTTTTATTCGTATTTTTGTAAATTTCTACAATACCGATCTCATCGATAATAACGATCCAATTCCAACGGGATTTGTAAATTTGTCCT
CCATCAACAGTGATTTCACCTCCGATTGAGATGTCATTAAAGAACTTGCTTTGCGCTTCAGATTTAAATTTACCATCGTTGTAATTTACTAAGTTGA
AAAATATCTTTAGCGTTCATTTTCTGTTCCTCCGTAGTTGATAGTTGTATAGTACCACAGAGGAACAGTCTTGTAAACCACTAAAAGAAACTTCTTTC
ACAATTTTTTCCACTGAACCATGCGCTTACCGCTTTCTTAGTCTCAGGAGCAGTGTTATCCATAAACCATTCAAAGGCAGCCTTTTTATGATTCTGG
AGGGCTTCTCGGGCTTTAATCTGCTCACGGTCTATTAACACTAACATATGAGCCTTTCTTGTCACCATGGGCTTCTTATGATTTTTGAATATTCCC
AATCATTTGTCCATCGCATCGTTGTTGCGAATTGAAGTACAGCTTCTTAATTTTAGTTTCGTAAATTTCACGAGCCTTTGAGTATAACATCATTAC
CTCCATTTACCAGTTTAATTCTAGTCATCTTTTTGATGGCAGTCCATATAATCTATTTCTGAACTGCCTTTTTGTCATAGAAGTCCTCTTATGAATT
ATTTCAGAAGAGTAACCTCAGCGATTTCTTCCCAACCGTTTTTGTCGGTCATAATAAAGTCAGCAAGATAAAGAGCAGTACGCAGTGAAACATTGCG
TAAACGATTAACATTGACTTTCATCCATGATAATGCTTTATAAGTTTCTTCATCAGAAAGACCGCGTTTTGCATCATGTCAGTTGAAAGAATAACA
TCTTCAACCCTGACCATAATTTCTTCATTAGTGTGAACACCCAAATCTAAATAAACTGAGCGGGACACTAATCGTTGTAAATGTGGAGCAAGTTTAG
TACCACGGTCTAATTCGCGGTCAATATCAACGTTTGTGATAAAAACAATCGTTCCTTTAAATTCAAACTCACGCTCAATGCCTTTTTCTTCTAAGTA
AGAAGATGCGGTGCTCCAGCAGACTTTACGGGTCTCTCCAGTGTCCAGAGCAGCTTTCAGAAGATTAAGAATGTCCATATCAGAGAAAACATCCACA
TCATCAATCAAAAGGACAGAATTCTCTTCACCGATTATTCCAAAGTTGTTCATAAAGACCGATACCGGAGATTTTACCGTTAATGCTTTTATATTCAA
TGTATCCATTATCATTTGCTTTATTCAAAGCTTTATCTAAAGAATACGTTTTACCAATACCCGCCGCACCAGAGATAATTAATGAACGAATGTTTCC
GTTAATAATAACCATTCGTCATCATTCCCATAACATTAAATCTTTTATTATGCGGGTTTTCATATCTTCATATGATTCTTTAACTTCTTCAACTTTT
ACACCATCATATGAAATGTCTGATTTGTAAACCCAAACACCGCGACGCTTACCGTCAATTTCAACAAAAACTTTACCATCTCCTTGTCGATCTACCG
GAGCATTATCTGGGAACCATTCACCTAAGAGCTCAAAAGTTCCAGAGATTTCTTTACCGAAGTAGATACCCTTATTGATAGTTACAGTTTTCATTTT
ATTCTCCAATCTCACATTTGTTTTGATAGGGTAATAGTATCACACTACTACCCTTCTGTAAACAATTTATTTTAACGTTCGCCAAATTTTTACTGCT
TCACGGCGAGATACTTCTACAGCTCCAAGTTCTACAGCTTTTTGGCGTCGGCGAGCGTGTAAGTCATAATGTTTAATGCGTTTATCTTGAAACCAAG
AACGTTTCATTCCTATTGCTTCTGCCATTTCATGAAGCTCTTACTCCATCAGTGAACATATGACAATTTTTAGTTGGATGACCGCGAAGTTT
CCATCCATGATTCATTAAAAACATCTACGTAAACTGTCATTGATTCTTCTCCAAATAAGTTTCGATAATTTTCTGAGCGAGATAAACTGCATTATCTT
CAGTTGCATCTTCAAGAAACTTTCAAAACACTCTGAAATTTCTTCTGTGTCAATCAACTTTTTTACTTCAATTGGTGTAATTTTCATTTTGTTTTT
CCGTTTAAGTGTTTGTTTTGATAGTTGTATAGTACCATAAAGCTTTATGCTTGTAAACAATTTTGTGAAAAATTTTTGAAATAAAAAAGGGAGCCCG
AAGGCTCCCTATCATTTATAATAACTTCGGTGGTTTTCAAGATAGACCTTCTCAAGGAAGTCATCCCAGAAACTCATGTCTACTTTTTGCTGCATAC
CGTTCTTAGAAGCTTCAGTAGATGATGCTTCTACTTGATCGACCACATCTTCCAAAAACTCTTGAACTGTTTTAAATGATGCTTACCCAACTTCAC
GTCGAGAATAAATGGAGCATCTTGGAGTGGATAAATCAAGTCGCCAGTTTTGTAAATTTCCAATAGTTGGAGTCCACCACGACAAGCATGACTCAAA
```

Figure 11(O)

```
GCTTTCCAGTCAATACCTTCATTGGCTTCGGCCTTACGAGCACGTTCACCATATTCAGCATCTAATTTGTTCAGTGACTGCTTAAGCTCAATAAGAG
AAAGCGTTGTCTGATATTTACGACCCAACACAGTGTAGAACGTTTGTGGGCCTGTTTTCTCATGATTATGGAACACCCATTCACAGAATTCGTTTTC
TGGAAGACGATGCTTAATATCTTCAACTTTAGTGCGACGCTGCTTAATAGAACCATCTTCTTGGTAATCAATCCACTGCTCAGGGATTTGATTAACT
ACTTTCAATACATCACGTAATGCAGCCAAACGAGAACCTTTGACACCGTATTTAGAAGCTTGCTTGCGGACATATCCTAAATATGATTTCATGTTAG
TCGTATAAAAACGAGAACGGTTGTCTTGAATAAACTTCCACACATCAGGCAAATCAGATTTAACCACTAGTTCAGGTGGAGTGTGAAGCATATCCAA
TGCTACAGTTTCACCATCTGCTGCTAATTTAAAGAAATATTTAAGACTGTATAGTTCATGGTCAATATCATCTTTAGTGTTTTTAGATGATGTGTTG
TTAGTGTTTTTACTCATGTGCTCTTTAACATTTCCAATAAGAATATCACGAGCAGGAGGAACAAAGATTTCTTTAAAATCTACATCAGATTCTGGGG
TAGAAGTTCCATAAAGATGACTACCAAAATAGCTTTTCATTACTGTTTTCATCATTCAGCCTTATATTCAATAACAGGACATACTTTAGCTTTACGC
GCTTTTAAAAATTCGATGATAATAGATTTCTTGGGTTGAATAGGAGGTAAACCTTTATACGCCCTATCAATATTTTCTACATGTAAAGCATAATCCT
TTTTCCATTTATAATCTTTATATTTTTCATGCAGTTGTGCAGGAATAACAAATGAACCAATAATAAGTAAAATAAGCAAAATGGCAAGTATAAATGC
TGATGGAATAAGAGTCCATAAACTACCAAAAATAAGCCATTTCTGTATGATTTCTGCACAGATAATAGTTAGACCTGCGAGTATAGTACATCCGAAA
AAAGAAACGAAAAATGTAGGGATAACAATAGACCAAAAGTATGCACACAGTGTCTTAGGTCGTTTCCATTCGTCGTTAAACAGTTTGAATAATTTAT
AGTGCCAAGAGTTTTCATTAATAATCATAATTATCCTTTCATTGAAGGTGTAACAGTTGTTAAATACTTAATCATAGCTTCAGCTTCTGATTTTGAT
AATGAAATTTCTTCATTGTTTTGACGAATAGAAATAAAATCCGGATGACGGTCACCACCAGCTTTTAAAACACACATATAAGTATCAGTTTCATCTT
CAATATCTGAAATGATTGAAGCAGTTCCACATGAATGTGGTTTTTGATAAATCAATACAGCTTTTCTTCCACCGTTTGACTGTTCATAAACTTTTAA
CACATCAAACAAATCGCTTCTTTTATCAATAGCTAAGATGTTGTTTTCATCTTCAATATTAAATCCTTCGGATACTTCATAAAGTGTCACCCATAAA
TCACCAATATCAATAACAGCGTTCACTTTTCCATGACTTTCAAGAGCATTACAAATTTTCTTAATTTCATCATAACTCATTTTAATAATATCATCTC
CTTGAATAAGGAAGATGTCATTTTTAAATTCAACACGAATTAAACCACTTCCACTTGAAATAAACATATTTCCTCACTTTGAAATCATAGTTGGAAT
GACAGAATCGAGATAAGTCTTTAGCGCAATAGCTTCGTCTTTGGTAAATGTGACAATATACGATCGAAAATCATCAATTTGACGAATAGTTAAGACA
TCACCATCTTCATAGCATTTTGATACGTTTAAAACAGTTTCATCATTCTGATTGCAAGCGTTAGTAATAATAGCATTGCAATTTTTGAGCCATTTTA
AACTATGTTTTCTTTCATTAGAATAATAAAAATATTTAATCTTATCTATAAAACTATCCCAATGAATAACTGATAAACACATTGACTCACTTTTAAT
ATTAAATCCTGGGCATGAAGAATAAAAATGAATTTTGTGCTCATCATTGATGCTTACTATTTTATCAGTATAAGGATATTCAATTTGGGTTAAATGA
ATGATTTCACTAGGCGTAAAATATAGCATATCGTCTTCTTGTGTCAAACGATACATATTATTTACTTTTTCTATAGCTAATTCACCAAAAAGCGGAC
TAACTTCTAATACTAATCGTTTCATATTGATTCTCTTCGACTCACCCACAATTACATACTCCTTTGAATAATATCAATAATGTTGTTCACCAGATTA
TAAGTAAACATTGGATAATTATATTGAATCATCACATACACAACAAACAAAACTTTCATTCTCTTCTCCTTGGCAGTTGACAAGATTACTATATCAT
AACCTTGCCAACTTGTAAACCATTAAATGACGTTTTCAATAAAATTCTGAAGCTTTGTGTGAGCATCAACCATGATTTTCATTTCTTCCTTTGCGAA
AGCTGTACCTCTTTCCCTAGCAGAATACTCATAGTCAGAAACTGCATTAGCATATTCTTCAATTAGCTTCATTAAAAACATCTGCTTTTCAGTTTTC
ATTATTCCACCTAATCATTTCAAGATATTGAACTAACTTAGCTTTGGATTTATCCAAATCCTTTTTAGCTGCTTCTATACCATCGTATGAGTATCCT
TCACAATGCTCAACTGCTAATTTGATATGAATCTATTTCAACATCACGTGCTAATTTAATAATTTTTCAAACTGTTCACGTGTTAGCATACTTAAACT
CTCGTATTATGATCGATAATTTCATCAAGAAACATATCTAAAGCTTCTACAGCATTATCAACTTTAGCTTCAAATTTTTCAATACCTTTATTTGCAA
TGCCTGCCGAAAACCAAGCAAAGTCACTAAGTTCCTCATCTGCTTTGCGAATTAAAGCTACCAATTCTTTAATTTTATCTGCTTGTTCAATTCTAGT
CATTATTCCACCACATATGAAAGAGAGAATATTGCACACGCCATATGAGTTGCAGCTTCATCACACATATCATAACGTTTCTTAAGAAGTTCTACAA
GTTCTTCACTAGTAACTTCATCCATGTCGACGAAAAAATCACCATTAATGATGACGTAGATATTTCCTTCTTGATTGAGTGCTTCAATTTTCATGAT
GTTCTCCTCTTTATCCGATGGTTGTATAGTATCACAGCTCAAATTGAAAGTAAACTGGTAAAATGAAAAAAGTCTCCCGAAGGAGACTAATGTTATT
CGAGGGAAAGAAGATATTTGCTCTGGTAAAACATCCCAGTAATATCATCTATCGTGCTTTGAATGGCTGGAGGCATTTCTTTATAAATGCTGTTAGA
TTGGTCTAGTATGTGATCAATCATTCTAATTGTGTCGGTAGGAAGTTTACTGGCATCTGGAATAGAAGGCGTGTATTTTCTACCAGAATACCCCAAA
TATTGCTCACCAAATTTATCAATCAAATCTGGCAACTCAGAGAAAATAAAATCGTATGCTTTGTGTCTAGCATAACTTTTAGTTTCAAAATGCGCAG
AATGAAAATAAGCTTGTGCAGCCATTAATAAACCTAAGTATTCATCTGCCTTTGAAGGTTTTCCACTTTGTGAAAAGTCGCTGAATTTCATTCAGTC
TCCAATTTAATGTTCATAATTCTAGCGTATGATTGTGCCATCTCCGCGCCTCGCTCTATACATTCAAAATCGGAAGAGCACGGGTCATTTTTATAAG
TCGTTCGCATAAAACTATAGAACTGTTCAGATGATTCTACGCTTTTATTTTCAAAAAGCATATAAACGTGTCTAATACCAGATTCCATAAATTTATC
AAAATGAGGATCGACATTCGCTTCAATTGGTGGAGATAAAGCAAAGCTAATCCTAGCATGGCAAATAGTGCCGTTGCTTTAAGGCCATAAAGGCC
TCCTATCATTTTTGTCCTGTATTCTTTATGCCGATGCACGGCCTTAACTTTATCAAGGTATTTTTCAAAATTTCGCAATCTAGTATAGTCTGCCG
GAGATTGGTTGAGTGATACTTCTCGACGCAAGCTGAAATGATATTTCCAACTTCCCTACGAATTTCATCTAATTGAAGAACAGTAAGATTGCGAAG
TTGCTTTTCAGTTAATTGTAGCATATATACCCCTTTAGTTAGATAAACCTATTTATAACTTTTGCACTAACCGAGCTTTTTAGTTAATTCATTCCAA
TGTTTTCTACACAAAGAAACATAAATTTCATCACCAATACAGATTTGATTACCTTCTTTAACTGGTGTTCCATCTTCCATTAATCGAGCTGTCATAA
TAGCTTTTTTACCACAATGACAAACTGCCTTTAGTTCAATAAGTTTATCTGCAATCGCCAAAAGTTCTTTAGAACCTTCAAATAATTTTCCAGCGAA
ATCAGTCCTTAGCCCATAAGCCATAACAGGAACATTATATGTATCAACAATTCGACTTAATGATGCACCTGTTCAGTTTTTAAAAACTGAGCTTCA
TCTACAAATACACAATGAATATCTTTTTGTGCTTCAGCCCATTTATAGAACTCAAAAATATCCATATCATCCGTAATAATATTCGCTTCCTGCTTAA
TTCCAATGCGAGAAACGACTTCACAGACAGAATCACGAGTATCAATAGCAGGCTTAAGAACTAATACACCCATTCCGCGTTCTTTATAATTATGTGC
AGCAGTCAAAAGAGAAGCAGATTTTCCAGCATTCATTGCTGCGTAAGTAAAAATTAAACTCGCCATATCACCTTCTTAAAGCGTATTCACATAAGCT
ATTAATTCGTTTTCTTTCTTATCAAACCGATCAGCAAATTCTTCTTGCTGATCGGGAGATAGCGGGCCGTATTCATCATAAAAGGTGTTTGCTTCTG
TATGCTCATCTAGAAGTTCATGGATAAGCTCAAACAATTTATCTTTTTACTCAGACTCATATTATTAATTTCCAGGAGTTTTAAAATAATT
CGCTTTTGCTTAAATATTTCCATAGTTAAATGACCAGTATCTTTTTGACCGATTCCAATGGCAAAACCTTTATTGACAGCGAGTTCAATTAAATTAT
CAAGCTCACGTAACACTTCATATTGTAACTCAAAACTATTCATTTCGGTTTACCTCTTTAACGAAATCAGGATAAGGATAAAATCCTGAATAAAAT
CCTTCACCCTTTATGATTGATGCATCCTTTATTAGAACAATAGCACCAATAATCGAAATCACAAGCCATTTCATCATTACATAAAGCAAAACAACTG
GCCATTCACACTTTTCGCAGTGGGCATTTTTAAGAAATACTAGTTTGGCTCAATAACATGTAACCTTTAAACAATATTCTTCTACATGTTGTTTACGA
CCTTTCCTATCAATAAAGGTATATTCAACGAATGTTCCAATATAGTCTTTATCTACATCATGTGGACTATTAATTGGGCATTTAGTACGCGCAAATGC
GTTCCCATTGACGAATAATTTCCACTTTGTTTTTAGGATCAAACGGATGCGGGTAATGTACTTTCATAATCCACCACTATTAAATCAATATCAGGAG
TAAACATGTCAATTAATTTAGAAACCTTATCCCAATCGCCGCCAGCAATACCGCAACCTATGCGTGGAATGTAAATTACTGGTTTAAACAAAAGGGT
TTCTGCCTGTAGATTTAATTCTATCATGCAGTTTACTAAAGCACCATAATCAAGATTAGGACCCGGTTCGTATTGTGTATACAGGTTATAGCATATA
CCAAATCCCGTAGGACTATGTTTAAAACAATAGCATCTGCCTAATTTATCACGAGAACCGTACTCGGTAGTGGTTTTTATCTATTTCTAAAATTT
TGGGATAGGCTCTTGCTAATTGACCCGCTACGCCAGAGCCCATTGTGTGAAGCAATTGCACCCGTGCGCAATAATATTACCTTGAAGAAATAGGGC
GACAATATCGCCCTTGATATATTTTACAATCATCTAGTACTCAATCCTCGATTATAAGAATCTACTAAACGGTCAACCATTGAATGACAAGCGGCTT
TATCTTTCTCCTCCGCAACTGAACATTCTAAAGTATTCCACTTTTTAGCATATCGTTTAACAATGTATCATTTTTATATCTGCTTGATTTATCTCT
TTCTCCGTCTTTATATGCATATATTTAATTTCTGCGCAAATTCAGCTTGGCATGCTTTATTTTTCCCACAATAATCCGCGGCAGTACGGTTTACATAA
TCTCTAATTTCAGTATATGATGTATCTGCTAACACAGAAAATGAAATTAATCCTATACATAAAACCAAAATTTTAGTCATTTACTATTTCCAAAAGT
```

Figure 11(P)

```
TTATTATTTTTAAGGTAATTAGCCTTTTCTAGGACTTCAGAAGCATATTTAGAACCTGCTTTAACATTCCATCCCGAATTATAAGAGGATATCGCCT
TTCTTATATCGCCCTTATGTGTATATTTAACCAATAAGAAAGTTCAATGTACGCCCAGGAAGCTGAATTGGACCGTTTATTCAACATTCTTTTTATTTC
AGCATCGGTCATATTATAACCAAGTTCCTTAACTCTTGCTCGCATAGTAGGCAAATAATTTTGGAACATTCCATAGGCATGATGCTTTGGTTTAGAT
TTTAAATTAACTCCGGCAGAGCTTTCTTGCCATAAAATAGCAGCCATTATATGACCTAATCCGCTCTTGTGGATATTTTTGTGTGTTTTATATTTTC
CATCCTTAGAAAATTGTTCCCCGAATTGATACGCGTAACGCATGTTATCGAGTTGGACATTACTGAAAGTATGCTCGGAGCTATGTGCCATCATTGA
AATGGCCAATAGACCAGCGAGTAGTGCTTTTCTCATGCTTACCTCATTGAGTTTTAATTACTGCTTTAGAAGCCTTTCCTGGTAAACGACGACTGTT
GATAATTGCCATCCTACATTGAAGTGACGGGTCTTTGAACTTTGCGTTAGGTTTACAAACTGTAAATCCAAGCCAAAGATTTCCATCTGTGATTTCT
AAACGTCCAGGACGATATTCAACCCCCTCCAATAAAATCCTCGTCAATGTCAGGACGCGGAGGCATACTCAGGAATTCATTAACTTCTAAAACATGGT
CTTTTATTTTATGGAATAATTCAAAAACATATGTCTCATCAATCTCCCGTTGAATTGCACGATCAAGAAGATGTTGAGAATATTTTAGATGAAACGA
TGAGACTCCTGCTGCTTTTGATGCCTCACGAATCTCATTGTTAATTTGACGAAACTCCGACTCAAAGTGACGACGAAGCTTATTCGACGGATAAAA
ACTTCTGTATTGATAGTCATGTTATTCTCCTCTTAACTGATAGAAAAATTATACCACAGTCAAGAGGAAAAGTAAACAGTTATTCTTTAAATCTAAT
CAATTTATTCATAGACTTTGAAACTTCTGCACGAACCTCATGTAGATTTTTGAGCTGTTCAAGACGCTGCTCATAGTAAGCAATTTCATCTTCTTCG
AGACAGTCCTGTGAATCTTCTTTAAGATAACGTGCATAGTCCTGGAAAGCGTTACGAACTACTTCCTGGAAGTCATCAAGACTTTGAATTTTCTTAG
GAGCAACAGATACACGACGAGGGGCAGTATAATACTCATAACCAAACCCTGCGCTTAATTGAGCCATTAGTATTTTTCCTCTGGTTGGAACGCTGCG
CGACAAGCCCACATACTGGCTTCTTTGAGTTTCATTTTAGCAATAGTTAACTGATCGAGGCTTTCGGCGTAATTCTTCGCGGAGTTCATCATCTTCAC
AGCTATCAAATGCTTCCCAGAATTCATCATATAAAGCATCAAAGATAAGCCCTAAACGAACTTCAGCATCTTTGATAGCATTCACTTTACTGATTTT
ATCGTCAGTATGTGGTTTATAACCTTTAATGTCTTCAATCATATATTTTACTTCCTCCACCTGTTCCCAAATCATATTCAACTAAACGAATAGGTTCATG
AATGCCATATCCTTGAACAGAAATTTCTGTCGTAGGATAAATTCCATTAATATCACCCATGTTCCATGCTTCGTTAAATTGCTGTTCGCCTGAATTA
CTAAACCACTCGGCGAAAGCATTTAGCACATCTTCAGAACCTTCAATAATTATCTTTGCCATTACAAACTCTCGGTGAAGGTACGAGCGATAACGTC
GCGCTGCTGTTCCGGAGTCAGAGAGTTAAAGCGAACTGCATAACCGGATACACGGATGGTCAGCTGCGGATATTTTTCCGGATGCTTAACTGCATCT
TCCAGAGTTTCACGACGCAGAACGTTAACGTTCAGGTGTTGACCAGCTTCAATTTTAACTGTAGGCTGTTGCTCAATTTCAATTTCACGGGCATGCA
AACCATAGAAAATTTCTGGGTCTACAAAAGAGTCCTCTTTAAAGGTTTTAGAGACAATAATTCGTGCTTGAATACCATCTTCAAAATAAATAGTACC
TTTATGTGTGCCTTCAAGAATTTGATATGCTTTCATATAACCTCAATTAGAAAATAAATTTATCCAAGATTGTTCTTTAATTAAAAATGGCTCAGAA
TCATATGCCATTAAACTCTGTGTGATTAGTCCTTTAAAAGGCCCATCAATAAATTCCATGGTAAAATATGGAATTTTATTCATTAGCCGTGCATTAG
GAGCCGTGCACAAAACTCTGCATCCTTTGAATACGCCTTTTTGTAATTTGTATTGCTTGGGATAAAATTCGCTCAAAATGTTATTTTTTGCCAAAAT
TTCAAAATGATTCACCAATTTATTTTTAATAGTTTTTGGCGAAAAATAAAGATATTCGAAAAGCTGAGTGTCTGTCATCATTGCATTCCGATTACGA
AAAACTGTGGACGAGTAATACCACCAATGCAACATTTAATATTACAGCAGCAGTGTACAGTGTCAATATGGACACTATAAATCTTATCCATATCAGG
AGATTTGACAGGCTCATCAATTATATACAAAATTCGCGAAAGCGATAAACCTCTGAACTTGCTTCCTTTATTACCAATAAAACTGCGCACAGAATCA
GTAAATAAACGAAAACGTATATCATCATTAGAATAACGCGAAAATTCCTTTTTAATATTATCTGCGGAAATTTTAGCGTAAGCTGAAGTATTAGAAA
GAACAATAACTGTTCCACCGTCATACAACCAATTAGCCGGCAAAATTAGTTACTGCAGTTGATTTACCAGATTGACGCCCACCATCTAGTCGAAGTGT
ACAATACTGTTTAAGTAAGTCTTCAAATGGCGGGATATATTCGTTTTTACAAATTTCTTCTACTCTAGCATCAGAATGGTGTGTAAAAGCATTCATC
AGGGATAGATAAGGACCAGTTAAAAATGTTCTCATTTTGTTCTCTCTAGGTTTGGGCCATTCCATGGCGCATGAATTGTCCATTTCTGTATTTACCC
ATTACCGCACTTGGGCTCGACCTTATTACAGGTTGGCGGGAATCCCTCACAGAATCATGAGGTCCAGGTTATTCCCATGTTATTTAAATGTAAAATAT
TTTTGCCGTAATACTTATACCAGTGTGGCCTTCATTAAAATTTTTTCATCGAGTCGTTGTTGACTCAACTTAATAGCTGATTTGCATGGATTATAATC
ATTTTTCCATTCTACTGGAATATCGCTGATGTCAGGAACTTCAGTATCTTTTTATACTGAACCCGCGTTTAAGCATTCCCGTTATAATGTCCGATTGA
CGCTTTCGCAAAAATTCTAACTTATCGTAAAAGAAAGTAACATGACCAGAACCTAAAATAAATTTAGAAGATATTTTAAAATCTTTAACGCGCTTAC
CGTTTGCCCACATGCTTACGAACTATACCAAAAACACGCGGCAATTCACGGTATTCTGCGATTAAATGTTGATCAGCAAGTTCAGATACTAAAGTCAA
ATTAATACGAGTCATTTTATCCCTCCAAGTAACTGTGAATATACTATCACAATTCTAGGAGAAAGTAAACAACTTTATAGATTTTTATACGCGTCCC
AAGTGCCAGTTCTAAACGTTGCAATGACTCGTTTTGCGCGATTAGGTGTTTGATTATACCATCTACTTTTAGCTAAGTTAACTGCTGCTTCATCCCA
GCGTTTTTGCTGGAGCATGCGTAAAGAATTAGTAAATCCTGCTACGCCGGTTTCCCCCATTTGGAAGACCATGTTAATCAATGCACAGCGGCGAACA
GCATCAAGAGAATCATAAACTGGTTTTAATTTAGCATTTCTCAGAATTCCGCGAACAGCAGCATCAACATCCTGATTAAAGAGTTTTTCGGCCTCAT
CTTTTTGTAATTACACCATTACAATTACGCCCAATAGCTTTATCTAATTCAGATTTAGCAACACTTAGTGATGGACTTTTAGTAAGCAAATGACCAAT
GCCAATAGTGTAATAGCCTTCTGTGTCTTTATAGATTTTGAGTCTAAGACCTTCATCTATACGTAACATTTCAAATATATTCATAATACCTCCTAAG
TATTTATAGAAGGTATTTTATAAATTAAAAGAGGCTGTTCATTATTCGGTAAGGTGAGGACCCATCACATATTGCCACTGATGACGAGGAATAAGAG
CAAAAGCATCCATCTCTGGAATCATAACGCCATCTTTATTTTCAAAATAAGACTCGCAATGCGAATTTCTAAACATCTCATGCTCTACTGGAATCGT
ATAATAAAATAACTGTAAGTCTTTATTACTAGAATATTTAAATACACCTAAGTCTTCTAGAAGGTCTGGATTATAATCGATAAAACCAGTCTCTTCT
GAGCATTCTCTTTTTGCAGCTTCCAGTGCATTCAAATCAGAACTTTCTACACGCCCCTTTGGAATATCCCAGCGATGTGCAATCATTCCAGGTTTAC
GAGAACCGGTAACTCGTCCCATAAATAAATCTTTATCTTCTGTCATAAAGATAATACCAGCTGATAATGTTTTCATTTTAATTTCCTGCATTCAGTG
ATAAAATTTATTTAATTTTTGACACATATTTCTTTTCATCAAAAATCTTTTCATCTGCGCGTAGCCGCATGGCGTTTCAATGAACGTGTACCATATCC
CAGATAATATTTGATGCTGTAAAAATATTAACAAGTATGGTTAAAAGAATCCAATCTCCTATTCTGTCCATTGGATTTTTTATAAAAAAGTAAAATAC
GAATGATGACACAGGAAGACTAATGATATACCACAGAATCATAATCTTATCTGTGAACCATTCAGCATTCGTTAACTTAGCACGACCATTATGAATA
CACACGAATTTATCATCTGTTACAGTAGATGGCTTAACTGCTTGATATCCCATTCTAAACTCCCTAATTAATCGTTTCTTTGTATCTTCAGAACAGC
CGCTCCAGTCAACTCTATCAACTGAAATGCCATCGTCCCCATCATCTAAATCATACCAGCGAGTTTTTAAAATCATTTAATTTTCCTACAATCGCTC
ACAAACTCTTCCATTGATTCTTTTTCAATATAAGACATATAGCTATTATATTCCTTTAATGTTGTATTTTGTAATCCTTTTTCCTTTGCCAATTTATTT
TAAAATTATCATAATGAAAATATAACATGGTACCAAAGAATGAAAATAATGAAATCGCTATAGTAAAACGAAGTTCACTCCAAACCCTCTGTTATAAT
TACTGTGCCGTCGATATTTAAATAAAACAGTCAATTAACAATCCAATAAGACTACCCGCAAGAGCTGTAAATACTGATACAGCAAGATTAATAGT
GCCTCAGGAAACGAATATTTGACTTTATTTAGTTTTGGCTTTTGCATCGTGATTCCTTAACAAATTTCATAATTTCATCAAATTCATACATATCTAG
CTTAAGCTGGTGTTCCTTTTTAATCTTTTTACACTGAGCTTTCCAATCACGTACACGTTTACGATAATGTCTTCCTTGTACACGTATCCTACCCGAA
TTTACAGGTACTAATAAAAGCGGAACTACCAATGGAAGAATTAGTGTTGCTCCAAATATTGCACCAGATTCAATATCAGTCATAACGTCTATAACCA
TTCCAGCAATCACCAGAATCACAAATGATACAACTACCACAGGACCTATTAACACATCAGTAGAAATTAGCTGACGCTTTGGTTCATACTTCACAGG
TTTACTTGGAAGGTATAGTGATGGCTTTGACATATTCTTTACATTCCTTAACAAATTTTTCTAATAATAAATCGCTTTCAAAATTGGGATTTTCTAC
GAATTTATCAAAAGATCATCAACAATAGTTAAGATATTCTTTTTACTAAGAATACGCTTATTTTCATATTTTGTTTCAGAGTCAACTATAAAAGTA
AAGAAATATTTCTTTCCCTGAAATTTTACCGTAGTATCAATATAAAATAAATTTGATTTTTGTAAATTACGTTTAAACCATGCATCACTTAAACTAT
AAACGCCAAGATAATCATAATCGTCGTTTAAATAACAAACCGTCCATTCAGGAGAATGAAATCAGTAAATTCAACATCAAATCACACGTCAATGA
ATGAATTGATTCAATACTGTTAATGAGTATTCCAGGACGTATTAAAGACTTTTTACCTCTAGAAAATCTTCCGGAAAGGCTTTCATCAGTTTCATAT
GAAGACCCCCAATAGTAATTACGTCCTTCTGCCATACGTTTAAGAGCATTTAGTAATTGATCTGGAACATCAACCTGTCTTTGGAACTCTTCAAACA
```

Figure 11(Q)

```
TTGAATTGAAATCACTTTGCATTTTCATTCCTATTTACTCCAAGTAATAGGGGCCGAAGCCCCTTATCATTATTTCAGAGAATTAATATATTCCTGG
ACATCGGCAGAGGTAGTTTCAACCCCAGAAATATTGCCGTTAAAAGTTTCAACTCGAGCAAGGGTATCTTCAATATCAACCTTAGTCAGTGCTGCAA
TTTCAACTACATCATCGGCAGTACTAATTCCAAGGGCATTTGCCGCACGAGTTTCACGGATATATTCCAATTTAACCGCAAGTTCTTGACGAGCATC
ATCTAACTCAACTACTTTCTTGGCGATTTCAATTCGCATTTCAGCATAACCGTCAGCCTTAGTAGTCAACTGCTCAGCTGTTCGACGATATAGTAAA
CCGAGTTTAGCATGCATTGTTACATCTTGGCCTTCGGAAAGAAGTTTACGAATTTCACGCTCTTTTGATTCGGCCTGTCGATTCTTTTCGATAACAA
GTTCACGAATACGTTTTTCTTCGTTAATAGATTTAACAGAAGCAGTTTTTAGATCTTTAATTTTATCAAGTAGTTTTGCTGCTGCAGCAGTATACTG
TTCTTCGACAGATAGATTTTTAGCCATAGCAGAACCAAGTTTAGTGCGAATAAACTCAACAATTTTCTTCAGTGTGTTCATAGTATTTCCTTAGGTT
AATTGAGATTTAAAATCCGTAGGAGTATAATACTCTATCATCAAGTTACAGGCTCATAATATCTCAATCATGAGCCTATGTAAACTTATTTCATATT
ATTAAAATATTCTTCTGCGATTTCGTCGTTATCGTGGTAAACTTTAGAAGACAGTTTAACATAACCTTCAGCAGTGAACATATTAATCACAACCTTT
ACAGTATACCACTGTCCGTCTTCATTACCCATTACTGCGTAAGTTTCAAACATCGGATGGTCAGGACCGATAACTTTAATATCATTCACTGTACGAC
CAAAATCTTCTGAAACGCATTTCATAAAGAAGTTGAACAGTTCGCCGTAATTATCCATTTCATTCTCCAAGTTGTTTTTCTGTATCAGTAGTTGATA
GTTGTATAGTACCATGGAAGAACAGGGATGTAAACCATTTTGTGAAAAAATTTTTAAAAGTTTTAGGGAATTCTAGGGAGGGATGGGCAATTAAAG
GATAGGATAATATATTATAAAGGGTATAAACTAAATGATGCCTAGAGAGGTCCAGAAAGGCCTAGATACCAAAAAGCCCTATCATTTAGATAGGGAT
TTAAAATTATTTATCTAGTTTAGTTATTATAGCTTCTGCAGCAGCTTTTAGCTTAGATGCGGTGTTAATACGATTTTTAATTTCAGTATACGCATCG
CCAAGAACATCAAGGCTATCAGAATAAACACTTACACTATTGCGTTCGCTATTTGAAATAGAACCTTTAGTTTTGCGGTCAAAATCGGTGTACACGT
CTTGAAGATCGCGGGCTGCCTTCTTTGCATCATCCAATGCATCAAGAGCTTTATTCAAAGCATTAACGTATTTTTTAGTGTCGAACATATTCTTAGA
AATTTTAACAGGTGCGCGTTCAGGAGTAGCTAACACAGATTTAGGAACCTGAGCGCCAGATGCCAATTTCTTAGAAATTTTGAAAAATGCTTTATTG
AATTTATTTTCTTGACTCATTGTAAAAGAACTATTATCGATGTTGTACATTTCAATAGCTTTAGCTTTCCATTTAAGAAAATCGCCGCGGTCTTTTG
GGTCCAATTGGAAGAATACTTTAGTAAGATCTGCTTCAGATGGTAATTTTGCTGCTTCGGTTAAAAATTCGGCATAGGTTTTCATTTAAAATCCTTG
AAATAATTTATCGGTTGGTTATTAATTATTTATTACTTTGTTACTATCCGTAGCAGCATTCTCTATGTGATTCAAACTAAAAAGCCCCAACCTTTCG
GTCGGGGCTAAGAATGTCATTTGATTTGTTTAGCAGACCAAATGCGGTCTTTAATAATTTTTGGATGTCTTCAACATACTCAAGAGAGTGAACATG
TGGATTATCTTTGAAACTATAAGCACGGGCTAACTTTTGGCCTTCGGTTTTGATTACTAAAAGCTCTTTAAGGATAGCTTCATATTTAGCGATAATT
CCTTTAACGATATTTTTTTCTTGTGCCGCTTTAGGATCTGCTTTAGGAGCAGGTTTACCAGAAGCCTTTGCAAAAGCAGCGCCAGTAGCAACTAGAC
TTTTCCAGGCCATACTAACTGCATTTCCCGTAAATCCTTCTGCTTTCATGTCGCGAGCAAATTGGAATCGTGATTCGTCAGAAGCATCTTTATAGGA
ATATTTACCCGCTGCAATGGCTGCTTTTGCGACAGCTTGAATTTCGGTGCTAGATGCTTCATTTAACACCGCTTCATTTAAAAATTGAGCATATGAT
TTCATCTTATTTCCTGTTTTAATTCGTGGATTTAATATACTACTGTATTTATACTAAAAAGCCCCAACCTTTGGGTCGGGGCTAAGCCTTGCGGCAA
CCTTGTCGGGGTTCCACCTGCTAAGGCAAGTGTTTGTACGAAACGCCGGGATTTGAACCCGGTTATTAAGCAGTTGACGCTACTCAATATTTTTAAA
AGGCCATATCTCGACCCATATCCGAACGTTCCGTCAAAAACGCTACTCGGCTTACGGCAAAGATATTTCCTCGAATCGATAATTCGGTGCGCCGTTTC
AGCTGTGATAGTAAAGAACCAGAACATAGTAAAACTGTGGGAGGAACTATACTCCAGGGAACATCAGTCCGACGACTTACCGGTAGCGACCCGGTTT
CTTAATATTCTTTTAAAGCATCAATATGTTCACGGCATTTACGCCATAAATCAATTGCTTCATACGCAGATTCAGCATTTCGAATTGGACGGCATTT
ATATAAAGACTTGTGATTTTGATATTGCGTAGATAACGGAATTTTATCTTAAAAGGTCTTTTATGTTCAAAGTATTCATAACCATCTAAGCCAAATGAA
CGATTTTTAAGAAATTGCCAATGACCGTATTCGTTTTCGACATAAACATAATCTGCATGCTGATAAAGCAAATTAATTACACGTTCAGAAATAACAG
TATCATTATGATTAAAATAGAATGTTAAATCATGAACTACTAAATAAACATTACCTTTCATATTTTCCTCACTTATAATTGGTCGAGGCAGTAGGGA
TCGAACCTACGACCTAGGACTTAGAAGGTCCTTGCTCTTCCTTCTGAGCTATGCCCCGTAATTGGGGTGACCGATGGGAGTCGAACCCATGACTACG
AGAATCACAATCTCGAGTTCTACCAACTGAACTACGGCCACATTAATACCTACTCCAACAATCAAGATGTCTTCACACGAAATTAAGAGAAGAGTGA
TCAGTTCAACCCCTATAATCGCGTCAAGTAGATATTAATGTGACAGTTGTCACAAATTTGGCTGACGTGATAGGATTCGAACCTATAACCAATCGCT
TAACAGGCGATCGCTCGCCATTGAGCTACACATCCAAATTGGTGGGAGTGATGGAGTCGAACCACCCGAGTCGCAATGACAATGGATTTACAGTC
CACACCGCTACCTCTACGGGATAACTCCCCAAATTAATTTGGTGGCCTCGGGTGGAATTGAACCACCATCTGGCGATTATGAGTCGCTTGCTTGAAC
CTTCCAGCTACAGGGCCTTGGTGCTGATTGACGGAATCGAACCGCCGACCTTCTCATTACAAGTGAGTTGCTCTACCTACTGAGCTAAATCAGCAAA
ACTGGCGGAGGCGATAGGATTTGAACCTATGAGTCGCGGAGCGACTGCCGGTTTTCAAGACCGGTGCATTAAACCACTCTGCCACGCCTCCAGTCT
CCATACAAGGATTTGAACCTTGGACCTCCTGATCCCAAATCAGGCGCTCTAATAAAAGACCTTTTCTGTTTCAATAAAGAACCTTCAAATATCTTATTACCATTCACAAAGAATAAGTCAAAT
AATCGAACTCACATCATCAGATTGGAAGTCTGAGGTAATACCATTATACGATATCCGCAAATTTGGTGCGAGAAGTGGGACTCGAACCCACAAGGAA
ATCATTCCGCAGCATTTTAAGTGCTGTGCCTTTACCAATTTGACCATTCTCGCGCTGGGAATAAAGGACTCGAACCTTTGCATCCTGGAATCAAAAT
CCAGTGCCTTACCAACTTGGCTAATTCCCAATTATTAACAAAGGCTCTCAAGCAAGAACCCTTGATGATAGAGGGTATTAATCAGTGCGGTATGAGT
TAATAATAACAAATAATTCTTAAAGCAAATTAAACATTTTAACGGTCGGCAAAACAATTTCTTCTTCTATATAAGAGTATTTAACACTCTCAACTAC
ACGCAAGAAATCATAGTCATAATATTCAGAAGCATGACCAAGAATATCAATAAGGCCTTCAAATATCTTATTACCATTCACAAAGAATAAGTCAAAT
ACACGTTCTTCATCTTCTTCGGATTTATTACCAAGGTCAACTTCTATATCAAAGACCTTTTTAATGAATTCTGGATAAAGTTGTTCTGAGAACAGTC
CTTCAACCAAGTATTCATAAATAAAAAGCGATTGCTCGCTGAACAAGCCATTACCACAATAACGTTCAGCTTTAGTACTAGAATGTCTGCTTTTAAA
CTTCTTTAAAAGATATTGGAACTGTAAGATTTCATGCTCTTCTACGCCAAACAGTGTTTTAGTTTTATAGTTGTCACCATCATTTTCCCAGGTAGTG
ACATCAATTACGTAGCCCTGCGGAATTGTAGTACCTAAACAAATATTCATTTTTCACCATGCTGCGTTAATGTAAGTATATTTAATACATTCAAGAC
CCAAAGGATTCTTGAAAATATCATATTCAAGAAGACCTTTTTCTGTTTCAATAAAGAACCTTCAAATATCTTATTACCATTCACAAAGAATAAGTCAAAT
TAATTTAACTTGTGAAGATGAACGGTCAATGTAAACCTTTTCAACTTCAAAACATGTTAAAATGCCATAATCATCAATCAAAGCTTTAGCCGCGTCT
TGATCATATTTATATCCATTTTCAATGGATGATACTTTCGCATAAAGAATCATTATCAGCCTTCATCAACAATAGTGTGAGTATTAGCATTTACGAT
TTGCCACCAATCAAAGCGATTAGAATCCATCGGTTTGTTTTCATTTTCTTTGATAATGTCACGGAGTTCATCTTCAGAGAATGCTTTAGCAATTAAA
TCGGTATACCCACCACGGGGATAATAATTATCACCTGCAAACAAAAGGAAATTTACCTTCCCGGAAGCAACATATGCTTCCTTAGGATACTTGTTTC
CTGCGTGGTCAACCACTTCAATATAACGGTAAGGAATATCGGTTCTTTCAACCTATGCGCCGCAGGGGAATCGAAAGCATCTACACCTAA
ACGATTATCTTCATCTTTAGACGGATTATTTTCGTAATCCGCATATACATAATATTCAACGTTCATTATTCACCTTTAGAAATTTTATCCATAACAA
TAGCAATTAAACCAATTAAAAATGCTACTACAAGTGAAAAAACATTTTCTGCCGTAGTCAATAATCCGCATATAAATCCAACAAACATTGAAAAACT
GAAAGCGGAAGCAGAAATTGCAATAGCAACATTTCGAATTAATTCACAACGTTTCATTTTATTCTCCTCAGTAGTAGATAGGGTAATAGTATCACTA
CCCTATCTAAAAGTAAACTTATTTTTTACGAAAAATTGATTTATTTTTCTGCTGCCCATTTTTCAATAACTGCAGCAGGACCAGTAACAACAATTTTA
TCACCGTAATCTTCTGCGGCGAGTTCAACGAAATTATCTAATGCATCACGAAGAACTCCATGAGCCATTTCACCCATTTTATCTTTGCCAGTGT
AAATAAACTCAACTTTTACATCAGCAGTTTCAGCAATAAATTCTTGGTAAGTTTTCATTTTGATTTCCATTTGGTTTTGTTTTGATAGGGTAATAGT
ATCACAACTAAAACCCTATGTAAACAACTTTGTGAAATTATTTTAAATCTTCTAATCGTTTCTTCATCTTAGAACCATTTTTAGCAATTTCTCCTGC
ATCGGAGCATAATGCTAAAAGTGCTTTAACTTTAGTTTGGTCTCCTTTAAAAGATGAAGGATCGACCGCAGCAGCAAGTTCTTTAATACGAGAGAAA
AGACGCTCAGCTTCAGCTAAAGCCATTCCAAGCTTTACTTCCATACCGTGGGAAGATTCAGTGATAGTAGTTTTTATAGCAAACTCTTTGAAAGTTT
TCATTTTTATTTTCCTAATTAATTTTGATGAGGTAATAGTATCACTACCTCATCAGTATGTAAACAACTTTGTGAAATTATTTTAAATCATCTGCCC
```

Figure 11(R)

```
AATCGAGTTTAAGAGGCTCTTTGTATTCACGGTCAAGTACAACCGGAATTTGTACATCACCGCTAAATGATAAGGGCCCAACATTATAAGACAATGT
TATATGCGGTGTGTAATCATCAAAATCGTGTGTAGCACCTAGTGCCCGCGCATACATGTGTCGACAGCGCAGATATTCAGAATCTAGCACAAGTACA
AGAGTCGATCCATCTTGTGTTTTCCACACTTCTAAATGTCCAGAAGAAGCTACTTCAAAACTTCCACTCGATGGAACATATGGAACATTTACTCTCG
AATAACATATGGTCGAATGAATTTTTTCTCTAGGAACTGGATTAGGAACACGTAAAGAGCGCTGGAGTTCTTCCAGCGCGTCAAGTGTTAATTCTGA
AAACTTAGCTGCTACATAAAGACCCGTTGAAAAGTCTTTAAATTCCATCATTCTTCATCTGCAGATTCAGCAGTAAGATTCTTGACAGCTTCAACGA
TTTCTTCAACTTTAATAGTATCGCCAGTGATACCTACTGCATGAGCAATTTCAGCCAAAGTTCCTTGCAGAATTTTGGATTCTTCCATCAGACGAGC
CGCTTGGTCCTGCGTATCAAGAATACGAGATTTCAGAGTTACGATTTCAGCAGACAGTTTTTGTTCAATAGTTTGTTCAGACATTATAGTACCTTTA
GTGTATTTTTAATTTTAGAAAAAAGTTCTTCAAGAGAACCATCGTTTGTAATTACTAAATCGCCATCACGAATTGGCAATCCAGCTTCTGTAATATG
TGTATCATTGGATTTTTGACCAGGACGAACTACATGAATTACTGTAGCACCCATCGCCCTAGCCGCATCCATTTCATGATCTTGACGGGTATCAGGA
ACGATATAATAATCATAACCTGAGTTAAATTTATCAAGATAATCTAAAGCAAATAATTTTACCCAGTACATGCGGTCGAAGTTATTAACAATCAAAT
CCGTACCTAGGGCTTGCATCAGACGACGGACTGACCATTGATCTTCAATATTATTTATAACGTCAGTAATTTTGTTAAATGCTACGAAATTAACTGA
TTCTTTTCCTTCGTCATCAAAAACAAACACACCTTTAATTGGGCTTTTACCATTAAGATAGCAAAATGCTTGTTCCATAATCGTGATTACTTCTAAT
TTAGTCAGATTTAAATTAGTCTCACGATCATAGTCAATTCCTTCAAACTCTTTACGAGTTAAGCAAGGATAGTCGGTGTTTGCTGCAAATACTCCCC
ATGCATAAGCCAATGCATCCTTAATAGGACCAGCAAGTTGGTATTTAACTGCAGAATAATTACTCATGATAAAATCAGCAGTAGTATCTTTTCCACT
ACGCTTTACACCGCTTAAAAAGATTAGTTTCATGTGTTTCTCCTCAAATTTAATTAAGATTATAACACACAAAGCTGAAGCATTAAACTTCTGCTAT
AATTTTACCATCTTTTTCTACTTGAAAATAGGTGTAAGGAATCGTTGCTGTACATACTAAAGCCGGGTCTGAATCTTCCGTGTAGCTAAATTCTACT
TCAGATAGGTCAGAAACCCAAGGCTTATAAAAATTTATTGACATCACGATTTCAGTTTTACTATTATCTAAAATGTAAAGCGTAATGTATTCAGGAC
CTGTTTTTTGGGCAGTATTTTCGCCTGTAAGATAGTTACTAGTTCCTAGCATCCATTCATACATTCCTATCCACGACTTAAGCTCTTCGTCAACTAT
AAATCTCACGATGAGTGGATCGTACTCAAATGTAACACCTGGACGTTGTGCTCGACCAAGTCCAAACGGCCCAGTCACGGTATCAGTAACAGGTATT
CTAATTCCTGGAATAGGAACTGACTGAGCATTTAAAGTAAAAGCAGATGTAGTATTACTATGTGGTATTGATACTACAAAGTTAGTTGTATTTGCTT
GGTTAAAAATTTGTTGCAGTGCTTGCGACATATATTCCTCATAATGCTTTATAAATGTTGGTGGTATAATGGGTCTAAGTCCCTTCCATTCAATTCC
AATTAGAACAAACAATAGAAAAGAATGGAAGATAATAGAATTAGATATTTGACCAGACTTTGTTTGCAGAGAAACGTTTTCCTTTTGAAACGAACTG
CTGAAGTGGCATTAACACAACGTTCGCCCAGTCTTTCGGGGCGATTTCAACAAGGCTACCCATAATATTACCGGGGATATATGCCTTAATCATTTGG
TCTGCACCCCTAAATCCTTTCACTTGACTCCAATCAATTTTTAATTTAGTTTTATTAGTAATAGTAGGTGTATTTGAATATTGCTTTAAAAGCTCTT
CTAGAAATTGCTGACGAGCTTTAGGTGGAATATAGTGCAAGTTTAATCCGTACATTAAATTATGTTTACCTAAACCAAGGTAAATTATTAAAGGAAA
TTTATCCCAGTAAGGAAGAGTTTCCTTGTGTTTAGCATCATAAGCAAAAGCATATATTCGTCCCGGCTGCGGGCGAACAACTTTATGTCCTTTTACT
TGCTTAATAGTTTCAGCAAACCACTTTCTGGTTTTATTATTAATTGCTGCGCCTTCATTACGAATTTTATCACGCAATGTTTGTCTGAATGAATTTA
TCATAAGCAGTTGTCTTTCTTGCTTATTGAGTTTATTCATTGGTTTTGATTCAAGCTTTTGAATCTTTTCAGCCGTTTTAATTCCTGAAGCATATTT
TGACATTGCCGAAGTAAACGTAGAGTATTTGATTCCTCTTTCTTCAGCAAATTGCTTTCCTGTCATTCCTTTTGCTTTGGCCTTTCTGTATTCAAGA
CCTATCTGAATCCATTTCTTTTCGTTTAATGATTGCTTAACCTTTGGGGAGTGCTTTCATTAATTATTTTGAAAAATAGCCATTATGCCCC
CTTAAAGCCAAGAGCTCGTAATCCATCTTCTGTTAGAATTCTAAATTTTATTCCACGCTTTTCAGCTAAAGATTGTGCTGCTTTCCATTTGTCGGTA
TTAACAGAATATGTATAAATTTCATTCATAAATCTTTTCTTCGCTGCGGTTGTTAGATGTGCTGGTTTAACTGGTGGTTGTGTTTCTTTTTTAGGTT
TTATTTCAATAAAAAATTCTTGTCCAGAAGAATCTTTCATCCAAATATCCATGAAGTATCTACGTTTTTTCCCTTCTGCATTACAAAAATAAGGAAT
TACTGCTGTTTCACTACCCCATGCAATAATTTCTGGATTTTTATCTAACCATTCAAAAAAGAATTTTTCCCAATTTGATCTATACGTAATTTTTTTA
GGGTCACCTCTATACTTTGATATATTTTTAGGAACCCATTTTCCAGAATATGCCATTGGATTCTCCTTATAAATAGATAATATATTTATAAACAGGA
GGGCCCATGCTCTTTACATTTTTTGATCCGATTGAATATGCGGCCAAAACGGTGAATAAAAACGCGCCGACTATTCCTATGACAGATATTTTTAGAA
ACTATAAAGACTATTTTAAACGCGCTCTTGCGGGATACCGCTTACGTACTTATTATATCAAAGGTTCACCACGCCCGGAAGAATTAGCAAATACTAT
ATATGGAAATCCGCAGTTGTATTGGGTTTTATTGATGTGTAATGATAATTATGATCCGTATTATGGATGGATTACTTCGCAAGAAGCTGCTTATCAA
GCATCTATACAAAAATACAAAAACGTAGGTGGAGACCAAATAGTATATCATGTGAATGAGAACGGTGAAAAATTTTATAATTTAATATCATACGATG
ATAATCCATATGTTTGGTATGACAAAGCGCGATAAAGCTAGAAAATATCCTCAATATGAAGGAGCCACTTGCTGCGGTCGATACGTATGAAGCTGCTGT
TCTTGAAAATGAAAAACTTCGTCAAATAAAAATAATAGCAAAATCAGACATCAATTCATTTATGAACGACCTTATACGTATAATGGAGAAATCTTAT
GGAAATGATAAGTAATAACCTTAATTGGTTTGTTGGTGTTGTTGAAGATAGAATGGACCCATTAAAATTAGGTCGTGTTCGTGTTCGTGTAGTTGGT
CTGCATCCACCTCAAAGAGCACAAGGCGATGTAATGGGTATTCCAACTGAAAAATTACCATGGATGTCAGTTATTCAACCTATAACTTCTGCAGCAA
TGTCTGGAATTGAGGTTCTGTTACTGGACCGGTAGAAGGAACTAGAGTTTATGGTCATTTTTTAGACAAATGGAAAACTAATGGAATTGTCCTTGG
CACGTATGGTGGAATAGTTCGCGAAAAACCGAATAGACTTGAAGGATTTTCTGACCCAACTGGGCAATATCCTAGACGTTTAGGAAATGATACTAAT
GTATTAAACCAAGGCGGAGAAGTAGGAATATGATTCGTCTTCTAACATTATCCAAGATAGTAACTTAGACACTGCAATAAATCCCGATGATAGACCAC
TATCAGAGATTCCAACCGATGATAATCCAAATATGTCAATGGCTGACATGCTTCGCCGTGATGAAGGATTAAGACTAAAAGTTTATTGGGATACTGA
AGGATATCCGACAATTGGTATTGGTCATCTTATCATGAAGCAGCCAGTTCGTGATATGGCTCAAATTAATAAAGTTTTATCAAAACAAGTTGGTCGT
GAAATTACTGGAAACCCAGGTTCTATTACGATGGAAGAGGCGACGACTTTATTTGAACGTGATTTGGCTGATATGCAACGGGACATTAAATCACATT
CTAAAGTAGGACCAGTCTGGCAAGCTGTCAACCGTTCTCGTCAAATGGCGTTAGAAAATATGGCATTTCAAATGGGTGTTGGCGGTGTAGCTAAATT
TAACACAATGTTAACTGCTATGTTAGCCGGAGATTGGGAAAAAGCATATAAAGCCGGTCGTGATTCATTGTGGTATCAACAAACAAAAGGCCGTGCA
TCCCGTGTTACCATGATTATTCTTACGGGGAATTTGGAATCATATGGTGTTGAAGTGAAAACCCCAGCTAGGTCTCTATCAGCAATGGCTGCTACTG
TAGCTAAATCTTCTGACCCGGCTGACCCTCCTATTCCAAATGACTCGAGAATTTTATTCAAAGAACCAGTTTCTTCATATAAAGGTGAATATCCTTA
TGTGCATACAATGGAAACTGAAAGCGGACATATTCAGGAATTTGATGATACTTCAGGAACAACGATACAGATTAGTTCATCCGACTGGAACTTAT
GAAGAAGTATCACCGTCAGGAAGAAGAACAAGAAAAACTGTCGATAATTTGTATGATATAACCAACGCTGATGTAATTTTTTGGTAGCCGGTGATA
AAAAGACTAACGTCGGTGGATCAGAAATTTATTACAACATGGATAATCGTCTTCACCAAATAGATGGAAGCAATACAATATTTGTACGTGGCGATGA
AACTAAGACAGTTGAAGGCAATGGAACTATCCTAGTTAAAGGTAATGTTACTATTGTAGTTGAAGGTAATGCTGACATTACAGTTAAAGGAGATGCT
ACCACTTTAGTTGAAGGAAATCAAACTAACACAGTAAATGGAAATCTTTCTTGGAAAGTTGCTGGGACAGTTGATTGGGACGTTGGTGGTGATTGGA
CAGAAAAAATGGCATCTATGAGTTCTATTTCATCTGGTCAATACACAATTGATGGATCGAGGATTGACATTGGCATTGACAGATTAAATCACATT
ATTTAGGAGAATCCATGGAAGGTTCTTCTATCGACGTCACCTTTACCGCTCAATTAGAAACAGGTGAAACGTTAGTATCTATAAATATAACTAGTTA
CGAAGAAACTCCTGGGGTTTTAGTAGAAGAAAATCGCTTATACGGAACATATGAATCTGTGTTTGGATTTGGAAATGACGCGTTGAAATATCGTTTA
GGCGATGAATTTAAAACTGCTGCTTCATGGGAAGAACTTCCTACTGATTCTGATACTCAGTTGTATTTATGGAAAGCTCCTCAAAACCTCCAGAAGA
CATTCACTTACGAAGTAACATTAATATATGACTACCAAGAACAAAGTGAATCTGGAGGTTCTGGCAGTAATTCTAGGTCATCTTCTGATACTACTGA
ACCGACAGATCCTCCTGCTCCAGTAAGAAAAACTCTCGTTAAAAATTTATCTAAAACTATAGTTGGAAATTGGAGTCGTTGGGCTAATAAATTAAGA
AGCTATGTGATGAGAGGTCATAGATGTCAGGATTAAGTTATGATAAGTGTGTTACTGCCGGCCATGAAGCATGGCCTCCAACAGTTGTGAATGCTA
CACAAAGTAAAGTATTCACTGGAGGAATTGCTGTTCTCGTAGCAGGTGATCCAATTACAGAACATACAGAAATTAAAAAGCCATATGAAACACATGG
```

Figure 11(S)

```
CGGAGTGACACAACCTAGAACTTCTAAGGTATATGTCACTGGAAAGAAAGCGGTTCAAATGGCTGATCCAATATCATGCGGTGATACTGTGGCTCAG
GCATCATCTAAAGTATTCATTAAATAGGATTTAAAATGGCAAATACCCCTGTAAATTATCAATTAACAAGAACAGCAAATGCTATTCCCGAGATATT
CGTCGGGGGTACATTTGCTGAAATAAAACAAAACCTCATTGAATGGCTTAATGGCCAAAATGAATTTTTGGATTATGATTTTGAAGGCTCAAGATTA
AACGTTCTGTGCGACCTTTTGGCTTATAATACGCTGTACATTCAACAGTTTGGTAATGCTGCTGTGTATGAAAGCTTTATGCGTACTGCTAACTTAC
GAAGTTCAGTTGTTCAAGCTGCACAAGATAACGGATATTTACCTACTTCAAAATCCGCTGCGCAGACCGAAATTATGTTAACATGCACCGACGCATT
GAATAGGAATTACATTACTATTCCTCGCGGAACTCGCTTTTTAGCATATGCAAAAGATACTTCTGTTAATCCATATAACTTCGTTTCTACCGAAGAC
GTTATTGCTATTCGTGATAAAAATAACCAATATTTTCCGCGTTTAAAATTGGCCCAGGGACGTATAGTAAGAACTGAAATCATTTATGATAAATTAA
CACCTATTATCATTTATGATAAAAATATTGATAGAAACCAGGTTAAATTATACGTTGATGGAGCAGAATGGATTAACTGGACAAGAAAGTCAATGGT
TCATGCTGGTTCTACATCGACAATTTACTACATGCGTGAAACTATTGATGGAAATACCGAGTTTTATTTTGGTGAAGGTGAGATTTCTGTTAATGCG
GCAGAAGGAGCATTGACCGCTAATTATATTGGAGGTCTTAAACCTACTCAGAACTCTACGATTGTTATTGAATACATCAGTACTAACGGTGCAGATG
CGAACGGCGCAGTCGGATTTTCATATGCAGATACATTAACAAATATAACTGTCATCAACATTAATGAAAATCCAAACGATGACCCAGATTTTGTTGG
GGCAGATGGCGGCGGCGATCCAGAAGATATTGAACGTATTCGCGAATTGGGTACTATTAAACGCGAAACCCAGCAACGCTGCGTAACTGCGACTGAC
TATGATACATTCGTTTCAGAGAGATTTGGTTCTATTATTCAAGCAGTTCAGACGTTCACTGATTCTACTAAACCTGGTTATGCATTTATTGCTGCTA
AACCTAAATCAGGACTATATTTAACTACTGTACAGCGCGAAGATATTAAAAATTATCTCAAAGACTATAATTTAGCTCCTATTACGCCATCAATTAT
TTCTCCTAATTACCTTTTTATTAAGACTAATTTAAAAGTCACATATGCTTTAAATAAGCTGCAAGAATCCGAACAGTGGCTCGAAGGTCAAATAATT
GATAAAATTGATCGTTATTATACCGAAGATGTAGAAATTTTTAACTCATCTTTCGCTAAATCTAAGATGTTGACATATGTAGATGATGCAGATCATT
CTATCATTGGCTCATCCGCGACAATTCAAATTGTTCGTGAAGTACAAAACTTCTATAAAACGCCTGAAGCAGGTATTAAATACAATAATCAAATAAA
AGACCGTTCTATGGAATCTAATACGTTTTCATTTAATTCTGGACGAAAGGTTGTAAATCCTGATACTGGTTTAGAAGAAGATGTATTATATGACGTT
CGCATAGTATCAACAGACCGAAATTCTAAAGGAATTGGTAAAGTTATTATTGGTCCATTTGCTTCTGGCGATGTTACAGAAAATAAAAACATTCGTC
CATATACAGGAAACGATTTTAACAAATTAGCAAATTCTGATGGACGCGACAAATACTATGTTATCGGTGAAATAAATTATCCAGCTGATGTGATTTA
TTGGAATATCGCTAAAATTAATTTAACATCTGAAAAATTTGAAGTTCAGACCATTGAATTATATTCTGACCCAACCGATGATGTTATCTTTACTCGC
GATGGTTCACTGATTGTATTTGAAAATGACTTACGTCCACAATACTTAACTATCGATTTGGAGCCTATATCACAATGACAGTAAAAGCACCTTCAGT
CACTAGTCTCAGAATTTCCAAGTTATCCGCAAATCAGGTGCAAGTACGCTGGGATGACGTTGGTGCTAATTTCTACTATTTTGTAGAAATCGCTGAG
ACAAAGACAGACTCGGGGGAAAATCTCCCGAGTAATCAATATAGATGGATTAACTTAGGATATACTGCAAATAACAGCTTCTTTTTTGACGATGCTG
ACCCATTGACATCATACATTATTAGAGTAGCTACAGCTGCACAAGATTTTGAGCAGTCTGATTGGATTTATACCGAAGAGTTTGAAACTTTTGCTAC
AAATGCTTATACATTTCAAAACATGATTGAAATGCAATTAGCTAATAAATTCATTCAGGAAAAATTTACTCTTAATAATTCTGACTATGTTAATTTT
AATAATGACACTATAATGGCTGCATTGATGAATGAATCATTCCAATTCAGCCCATCATATGCTGATGTTTCATCAATAAGTAATTTTATTATTGGTG
AAAATGAGTATCATGAAATACAAGGTTCTATTCAGCAAGTATGTAAGGATATTAATCGAGTTTATTTGATGGAATCAGAAGGGATTCTATATCTTTT
TGAGCGTTATCAACCTGTAGTTAAAGTATCCAATGATAAAGGTCAAACCTGGAAAGCTGTAAAGCTCTTCAATGACCGTGTAGGATATCCTTTATCT
AAGACTGTATATTACCAATCTGCGAGCACAACATATGTTCTAGGATACGACAAGATTTTCTATGGCCGCAAATCTACTGATGTTAGATGGTCAGCTG
ATGATGTCAGATTTAGTTCGCAGGACATAACATTCGCTAAACTTGGTGATCAACTTCATTTGGGATTTGATGTTGAAATCTTTGGTACTTATGCTAC
ATTACCTGCAAACGTGTATCGTATAGCTGAAGCTATTACTTGCACCGATGATTACATTTACGTTGTCGCCAGAGACAAAGTTAGATACATAAAAACG
AGTAATGCACCTATAGATTCTGATCCATTATCTCCAACATATTCGGAAAGGCTATTTGAACCTGATACAATGACTATAACTGGAAATCCTAAAGCAG
TATGCTATAAAATGGATTCTATTGGTGATAAAGTTTTTGCTCTTATTATCGGTGAAGTTGAAACATTAAATGCTAATCCTAGAACGTCAAAAATAAT
TGATTCTACTGATAAAGGAATATATGTTTTAAATCATGACACAAAAACGTGGAAAAGAGTTTTTGGCAACACTGAAGAAGAAAGAAGACGTATTCAA
CCTGGGTATGCGAATATGTCAACTGATGGTAAATTAGTTTCTCTATCTTCGAGTAATTTTAAATTTTTAAATGATAACGTTGTTAATGACCCTGAAA
CTGTAGCAAAATATCAGTTAATCGGTGCCGTTAAATATGAATTTCCTCGTGAATGGTTAGCTGATAAGCATTATCATATGATGGCATTTATAGCAGA
TGAAAGTCTGATTGGGAAACTTTTACGCCTCAGCCAATGAAATACTACGCAGAACCGTTCTTTAATTGGTCTAAAAAATCTAACACACGCTGTTGG
ATAAACAACTCTAATAGAGCTGTAGTAGTTTATGCTGATTTAAAATACAC
```

Figure 12(A)

K2 contig 1, site A Nanoluc insertion only (SEQ ID NO: 23)

```
ATGTGTTTCCAGAAAATTTCTTCTTTAACTACATCATCTTTACGAGTATCGCCTTGTTTGCGTTGGATATGCAAATTAAACGGAATATCGTTTTGTA
AAAGCCACTCACGTGTCATAACATAATATTTTAACTTAGCATTTTCGGTGCCAGATTCACGTCCGCTTACAGTAATAATCTCATAACCCGAGTGATG
AAGCATCTTCAGATATTGTACAACCATTTCGTTTGGTGTATCGGTTGATAATTTATCTAATTCGTATGGGCCACGAGATGTATGAATAGCTAGTGTT
CCATCAAGGTCAAAGATTGCAGCTTTTGGTTTTACCAGGAGTCCCTTTGTATACCGGAAGACCGAGATACTCTCGCATACTTTTATACATTGAGCGTA
AAACATCAATTGGTACTGCTTTAGTTCCACGTTTTGAGTTACGTTTAACCAATTCAGTCCAAGGAACATCAAACACTTTATATTCAACTTTCCATCC
GTATTCTTTGGCAAAAGTTTCCCATGCTAGGCGACGTTCAGGATTCAAGTTAGTGTCTGAAATAATTACTCCCTTGACAGAATCACCGCCGTACAGA
ATACTCTTCGCGGTATCAAACTGCATACCGGTCACAATGCCTTCTTTCTTTTTGGTATACTTGTACTCGTCACGTTCTTCATGACCCATGATGGATT
GACGATAATCATCACGATTGATATTATAAAATCCAGGATTTTTAGCAATAAATTCACGAGCCCAAGTGCTCTTACCTGAACCAGGACAGCCAATAGT
TAAAATAATCTTTTTCATCATTTAATTCCTAAGAAAACTTCAAGAATACGAATATTATGCTCACGTCGCTCTTTATACACTTCAGCTGTTGATTGAT
TCACTGATTTGCTCTGAACATTAGATGAAATAAATTTTATCATGTGATTTTTAAGCTGATACATATCAAGTCCACGAGCTTTTGCTTCTTTTCGTAG
AGCTTTACCAGCGTCATCTAAAGCTTTCGTAGGGTCTTCATCATTTAATACTATTCCACGATCCAAATCCATGTATACTGCACCATGACATGCATCA
ATGTAAAGGTCTGAGCATTCAATATAACGTTCTAACAGAGTTTTCATTTATTTTTCTCAACTAATGATTGAATATAATCATGCAGGTCTTTAGATGC
TTTACCCCACTTATTTTGATATTCATTTTTGAGATTAGCACGGGATTGAGCTAATAAAACATCATTAGTTGGAGGTAAAGATTCTAACCGCTGAATC
TGGCGTCCATAAATCATTGCAGCCATCTCGGATTCATAAATCAATCCTTTGAGATGTTCAAATTGATGCCATGAAATCATTTACATTTATCCTCTTT
TAACTCTTGACGATAATAACATATCATAGTTTTTTGGTCATGTACATATCGTTTTACATCATTAAGCCAAATACGAAATTCCTGGGAATCTTCAAAT
GACATACCGACCCAAGCTTTACCATCAATAACTTTAACTTGCCAAGATAGTTTAGCTTCATCATATGACTTTATCTGTACAGGCCAATTAGGATGAA
CTGTTTCTTTCTTTACTTCTAGAGGCTTTGTCGAACAACCAACTAGAAGACCAATAGATAATATTACTGCTGATAGTTTAATCATTTAGAAAGGTCC
TGGATGTCTTCTGCGAACTTGTTGAAGGAGTTGTTGATTTGTTTTTCAACCAATCCTGGCTTACGAGCCACCACATCCGCCTTCTTTGCATCTTTGC
GCAGTTTTTCATTTTCACGCTCAATAGCAGCAATCGCCTCACGATTTTTATTATTCATCGCATCAATATAATTTATACTGAATTCGCAAATTATTTAA
TGCTAAGGCGTTTTCATTGGCCGTTTTTGTAATTTCTACAACAGACGTTTCTAATCTTTCAATTTTATTTTTTAAAATTAAAGAAGTTCCGCCTAAT
GCAATTACAATTAATAGCAAACCTGCTGTCGTATTACTTAATTTAAAATGAAAACCATCTTTCATCACAGCAACATAGCCTTCGATGTTTTCCGCATT
AATATGATGTTCAGCCGGAGATTTAGAAATTTTAAAGCACGCCGAACATCTTCTGCCATATCCGATGCGCTACGATTTGGATTACTAATTCCAAGA
CGATGTTTTCCCGTTAAAGGATTAACGATGATATAGCATTTACAGTTGTTAATATGAACATTAGGTTGAGTCTGATTAATAAACACTTCACAATCAT
ACTTAGCGAGTTGATTTTCTAAAAAGACTTTCATCTCCTCAACCGCATCAGGAAGCATATCACGGGCTTGCTCAAGACGACGATTTCGATATTCTTT
AATGGTCGTTTTCCGCTTGACTTGCTTAGCTAAATCTTTCTTAAGATCGGTGATATATCCAACTCGACGATTTCCTTTAAATACGAAATCCCATCT
GTAGTATCACCGTATGCTTCAACGACCCATTTCAGTAGTAATAAGCTGATAACATCATAAAGTCCTCATGTTATGTCAGTAAGTCTACTATAACAC
AACACGAGGGGTTTGTAAACAGCTTAGTATCCTTCTGGGATAAATTTTTTATAATTTTTCAAAAAATTCTGTTCGATTTCACACATGACCTTTTCTT
GACTATCGTACCCCTGGTATAAGCTCATGATGATACCGAACAGATGTTCCATTCCAGCACCTTTAGCAACGCCTTGCGCTTCCATTGCATAAGTCTT
TCTATCCTTACCACAATGTTTATTGTGACAGTCAAGAACTAAAAACAGAGCTCGGTCTAAGTACTTCAGATAAGTCGTTTCAAACGCCTCAATTTTT
CTGTATGAATATTCATCATCAGCGTACATTGCTTTAAGATCATCTGATGCACCATCAATAATAGTCTTAAACAGTTTTTCTGGATTGTCTAATGAGC
TTTTTGTACTATGAAGAGACACGTACCAGTCAGACTTAATTTTAAAATGAGAACCATCTTTCATCACAGCAACATAGCCTTCGATGTTTTCCGCATT
TTTAGCTTCTTCTACCCATTTAGGGCTATCGATTTCGTATCGTTCAACTAGATATGGACGAAGAACAGCATCTTTATAAATGTCATCATATGAAATG
TATTCACCTGTTTCATTTTCACGAATATTCAATAAAATGATTTTCACCTCTTGATAAGCAAGAACGATTCTATTAGTTGGAGCGACGAATTCGAAGT
TAGCAGTAAATCCATCTTCAGCTAATTCTTTAAGTCTATCACGCAACCGATGGTGATTAATATTCATCAAAATACCATTAGCCATTAAAGCCTGTTC
GGATTTGATTGAACCCTTTGATTTGAACAGAATTTCATCACCATCTAAATAAGTTGATACCAAAGACCCATCTTCCTTTGTCAGAATGTAATCAACA
TCATTTAAATCGATATTCATCGTGAATGGATTTTCATTTAAGTTAAAAAACTTTTCCATAGGACGAGAAGCAATTCTTACTGGTTTTTCTCCATCCA
TTTCAAACATGATTCCACGACATTCCAATGCATCTGGAAGTAACCAATCAGAATAAGATGCATAATTATATGAGAAAATTCTGTAAGTTCTTCCAGA
TGCACTTACATCATCTGAGTAAAAAACTTACGCTGTGAATCCTTACATAGTTCCATTAAATTGTTAAAAGTTCTTGCATTGTGTATCCTCTTTTG
TGTTTTGAATATAGTACCACACTCCATGTGGAAGCATCATTTTTTCTTATGTTGAATATTCCAAGGCGGGTTAAACAGCTTAATGAATAGTGGTTCC
TCTAGGTCAATCGTCGCGATTGTCATTGTACCTAACTCATTTGTCATAGAAAGATTAAAACATTGGCGGGCGTAAAATTCAACTTTGCTTCCTTCCT
TTAGCGCAGAATGAATTAATGCAGATTTAGTAGAATCAGACGTTTTGTCTTTACGATTAATAGCAGTTCTATAATAGTTTATTCTTTTACGTAAATT
TTTAGTTTTTCCAATATAAACAAGCTCATCATTTATAGCAATAGCATAAATTACGTTATACTTGTTTGGAATAGATAATTGTTTTATACTTCCGTTG
TCGTCTAATTCTAGCTCAGTATATTTAATAAATGAATATTCTGTTGCAATTTCTTTCATAATAAAATGGGCCTTGCGGCCCACTCCTTAAAAGTATT
TTTTAAAACTCATCATAACTTTATCATCAACATCATTATCAATCTGTGCAACAAGATAAGATGACAGTTCTACTTCTTGCGGCGCGGATTGAACATT
ATCAGAATTAAGGTATTCACGAATCCAAGGATATGGATGTTTAACCGGAGCACCGGTAATTGGGCATGGAAGACCACACTGTTTCATACGAGATACA
GTTAAGTAATCAATAAAGCTCCACATGCTATTTGTATTTAATCCAGGAACATCGCCATCTTTAAATAAATGAACTGCCCAATCTTTTTCTTGGCCGT
TAACTTCCATGAAAATATCAACTGCTTCTTGNTCNCACTCTTTGGCAATTTTAACCCATTCATCACCATCAGTGCCAAGTTGAAGTTGACGAATAAT
ATATTGTGTACCTTTAAGGTGGAGTTGCTCATCACGCGCAATAAATTTCATAATCTTCGCGTTACCTTCCATGATTTCCATATTCTTATGGAAGTTG
AAAGTACATGCAAAAGATACATAAAAACGGATAGCTTCCAGGGCATTGATAACGTGCAAGCAGAGATAAAGCGACTTCATCAGGTCACGTTTACAAC
CTGCAACATGGTCAATAGCGTCTTGGACAAGTTCTTCATCATGCTCTGTTGCCAGGTAGAATTCTACGTCAGCTTTAGCGTTTTCCCATTCACGAGT
CTTTACCAGAACATCATCATAATAACGACCAATCGATTCAGCACGTTTGTCTTTACGATTAATAGCATCATCAAGAATAATCTCATCAAATACCTTGGCAGGGTCA
TTGAACAGGTTACGCATGATGTGAGTATAAGAACGTGAGTGAATAGTTTCACTGAATGTCCAAGTTGCAGTCCATGTATCTAATGACGGGTCAGAAA
TCAATGGCATCAGTACTGCTGCAGGAGCACGTCCTTGAATACTATCTAACAATGACTGATATTTCAGGTTGTTAGTAAAAATATTTTGCTGATACTG
AGGAAGCTTATTAAACTGTGCAGCATCCATCATCAAGTTTACTTCTTCAGGACGCCAGAAAAATGATAATTGCTTTTCGGTTAAATCTTCAAAAACT
TTATGACGTTGAATATCATAACGTGCAATGCCCAAGACCTGAACCAAAAAACATAGGTTCTTTTAAAACATCAACTGGATTTGTATTAAAAACTGTGC
TCATAAATTTTCCACTTAGTTAATAGTTGGTGACTCGTCCATGAGTCAAATTATATCATAATTTACAGGATGAACAATCTTCAGCTTTTGGAGTTTC
TATTTCATAATCATCAGTACCAGAACCGTCACGGGTATTATGATAATAGAAATTTTTCCGCCAAAATACCAGAAATACAAAAGGTCATCAATCATT
ATTGACATTGGAACCTTGCCTTTAGGGAAGATTTGGGGGTCATAGTATGTATTCGCTGAAGCTGATTGACATACCCATTTCAGCATAATAGCTACCT
GCGTAAGATAAGGTTTATTACCCTTCTTAGCTAATTTCCATGTATAATCATATAAGTCTATGTTATGTTCAATATTGGGCACGACTTGATTAAAGGA
ACCCTCTTTTGATTCTTTAACAGAGACTGGTCCACGTGGAGGCTCGATACCGTTTGTACTGTTAGAAACTTGGGAAGATGACTCACATGGCATAAGT
GCTGATAGTGTGCTATTACGGATGCCAAAGAGCTTAAGGTCTTCCCGCAGCGACGACCAGTCACAAACGTATTTTGGAGCTGCGATTTGGTCAATCT
```

```
GAATCCATACCATCACAATATTCATTAGCCATAAAGCGGGTGAGGTCTTCAAGAGGACCTTCAATGACAATAGAAAAATTGCAATAATTGGGATCAT
CGTGAATACTTGTGATACTAAGTTCAGGATAACGATTACGAATAATTTCTTCAATATATTCAAAATCAACGATGTCAATATCAACTTTAGCCATATT
ATTTTCCTCTTTAATTATCAGCAGTATTGCCGATAGTTGTATAGTACCATGGAAGGACAAGGATGTAAACCGTTTTATGAAAAATTTTTGAAATAAA
AAAGGGGACCTCTAGGGTCCCCAATTAATTAGTAATATAATCTATTAAAGGTCATTCAAAAGGTCATCCAGGTCNGTGTCATCAGCACTAGATGAAC
TGCCAGAGCTTGAGCTCATAAAATCATCTTCAGTTTTTGTATTGAAGTCATCAACATTGAATGCATCCAAATCATCAGCAACTTTATCAGCTTTCTT
AGCAGCAGTTGCAGCGGCACCGCCCATCACAGCAGTTCCCATAACTTGACCGAATTTAGTGCTCAGTTCTTCAAATGATTTGAATTTATCTTTAGAA
GTCATTTCAGAAAGGTCAACCATTTGTTCGAACAGTTCTTTCTGGAAAGATTCATCGTCAATGTTTGGAATCGCAGATTGATTCAGGAATTTAGATT
CGTCGTAGTTACTAAATCCAGAAACCTGTTTAACTTTCAGTACAAAGTTAGCACCTTCCCACGGACAAGTTACATCAACCGGAGTTTCACCCATTTC
AACATCAACCGCAATCATCGCGTTGATTTTATCCCAGATTTTCTTACCGAAACGATATTTAAATACTTTACCTTCATTTTCTGGAGCAGCTGGGTCT
TTTACTACAAGAATGTTAGCCCAGTAAGAAGTTTTACGTTTAACAAGACGTGTACTCTTTATTGTCAGTGTTGTACAGATCATTTTTACTGATATACT
GACATACTGGACAAGAATCGTAATCACCGTAGGTAGATGAGCATGTTTCGATATACCATTTACCATTTTTCTTGAAACCGTGATTTACAAGAAGTGC
GAATGGTGCTTGTTCATCATTTTTAGACGGAAGAAAACGAATTACTGCTTGACCGTTACCCGCATTGTCGAGTTTCAGTTTCCACTCGCCTTTATCT
TCAGAAGAAAAACCACCTTTATTTCCAGCCAGTTTAGCCATTTGTGCAGCGAGTTCAGCAGTAGATTTACGTTTAAACATTTTTATTTCCTTTTTAA
TTTAATTAACAGTTGGTGCTATGACGATGTATGACCTCATAGCTGGTCAGTGAGATAATTATAATCTATTTATAATAAGCAATTAATACTTGCAAGA
TTTCACAGTTTCAATGAAAACATTTTTAGCTTTCTGTGAATCAATATTTAAAATTTTTCTATAAGCCTTTAACTTTATAGAATAATTATTCCAGACT
AAATTATCAGTCTGTTCATCATGTTTATCAATTATATTTAAAAACGAATCAAGCAAGATAAACGTCTCAAACGAAATTATGTTCGATTGCAGAAGTT
TAAAAATATAACTTGACTGAACCTTTGGATTATATTCAAAGATTTCTTTAAAAGCAGAAACTTCAACTTTTTTACTAAAATAATAAATGTTGCGAAT
ATCTTCTTCAAACTTAAATTTAATTTGCTTTAAGCGTCCGATATATTCACGATAAAACACAAGTGCATCAGCGTCAGAGATGTCACCAATCCAAGCA
TCTTGGTTAGCAACCAGATTGCTTATAAAGATTAAAGCAAGTTCCTTTAATTTATATTTTTCTGATAACTTCTGGAAAAAATACTTATCCCTTCGCT
TTTGATAAGCGGCATCAGACACCCGCATGCACCAATTATACTTAATTACATCATACTTTCCATTCATATGTTGTTTTATCATTAAGTATAATTTATA
AACTGATTTACCATCAATATATCTTTCACCAACAGCAGGCATGCGGAGTTTAATCATAGTAGAAAATCTAATGTATTAGTTTTTCACAACGAACAA
CAGAAGGACGTAAAAGATTTTCGTCAATAGCTTCTGACTGAATTTTTTCAATTATACCCGAAGGAATAAATTTAGCAAATTGAGTTTCAGGAATAGA
ATTTTCTTCTAAGAATGCTGTTGTAGCTTCGAGATAACTCATTCCAAACTCTTCTACCATTTTTTCAATAATAAATCCATTTCTTGGCGGTCAAGA
AGCTTTGCAATTTCATCCTTTTCTTTCTTAATTGAAAGTTCTTTTTCTGAAAGACCGGTCTCATCGACCGGACGAATATCATTTAGAGAAAACTGTG
TCATAAAGTTCAACTACCTCTTCAGTTTCAGCTTCAAACACATCACGCGTTATCTTTATGATACAAAGCTAACAGACGATTAAACATCTTGCCATCAA
CACCAAGTTCATCTTTGGCACGAATTCGAATATCTTTAATCAATTCATTATAACCAGAAATTTTCAGTTTATGATCAGATGCTTCTTTAATAAATTT
AGCCAAGTCTTCGCCATGGATAGCTTCATCAAATTCAACCATTTCTTTTTTAGCCATTATTCACCTCAAAATTCATTAATGCTATTAGTTAATTTAG
AAAGACCCGCTTTTACAAAATATGAATAAATTTTGCCGCGCGGTGGTAATTTATATGAATTATAGTAATTCACAATGTTTGAAGCAATATATCAGG
AATATAATCAAATCAATTAGAACTAAATTTTCTTTATAACGATTATATTCAGATTCTGTGAGAAGCACCTTAGCTTGCTCACGGTCATTAGCAATA
GCTTCAACAATAGAGGTTTTCATTGAAGGAGTTCGTTCACCTTCAACTCTGGTAAACCAAAAGTCAGATCGTACTTTAACTGAAGCAACGTTATCCT
TTTTGTCGCCTTTAAGGATTTTAGTCATACAGTCAATTTCAGCAGAACCGCTTTTAATTTTAACCCATTTCTTGTGCATCGGTGACCATTGCTTAAC
ATTTGGGTATTTGTGAAGTTGAGTAAAGTCACCATCCGACGAAATGATTAAAATCTTATGTCCTTCTAAAGAGAACTTTTTAACAAGAACAGCGATA
TGATCATCTGCTTCATACTTATCAATATCCATAACGATGTATGGCATATAAGCTTTCAATTCATCTATAACTTTATGGCTGGATTCAAAATAACCTT
CCCAGTCCCAAGTAGATTCTTCTCGTGCTTTTCCGCGGTTTTCTTATAATAAGCGAAATCACGGCGCCAGTATCCAGATTTCGCGTTATCAAT
ACACAGCACAATTTTAGTGTATCCAAGAGTTTTTGCTTTTTTGACATTAAACTTAATTGAGTTCAATATCAAATGACGAACCATTGATAAATTAATT
TTTTCTTTATCTGGGAAGTTTACAAGAGCAGTTGAAAGCGCAATTTGACTAAAGTCAATAAAGCAAATTCCTTCTTTATAATCTTCATCCAGCATCA
TTTCTAAATCCATATGAACCTCGTTCAATTAGTGAGATTTCTATTATATACTATCTAAATCTTAAAGTAAACAGGTATAAATACTTATTATTGAAAA
CACAATAGGAGCCCGGGAGAATGGCCGAGATTAAAAGAAAGTTCAGAGCAGAAGATGGTCTGGACGCAGGTGGTGATAAAATAATCAACGTAGCTTT
AGCTGATCGTACCGTAGGAACTGACGGTGTTAACGTTGATTACTTAATTCAAGAAAACACAGTTCAGCAATATGATCCAACTCGTGGATATTTAAAA
GATTTTGTAATCATTTATAATAATCGTTTTGGTCAGCAACGGATAATATTCCAAAACCTGCTGGAAATTTTAATAGAATTCGTTGGAAAGCATTAC
GTACTGATGCCGTATATACAACCGTATCATCTGGACCATATCAATTAAAATCCGGAGAAGCAATTTCAGTAGATACATCAGTTGGCAATGACATTGA
GTTTACTTTACCACCTTCTCCGCTTGATGGAGAAACCGTAATAATTCAAGATATCGGTGGAAAACCTGGCATAAATCAGGTTAAAATAAATTCTTCA
AATCAGAGTATTGTCAATTTTAGAGGTGAACAGGTACGTTCAGTTTTAATGACTCATCCAAAGTCACAGATGGTATTCATTTTTAATAACCGTTTGT
GGCAAATGTATATTTCTGATTATAGCAGAGAAGCTGCAATTGTTACTCCATCGACTGCATATCAAGCACAATCTAATGATTTTATCGTACGTAGATT
TACTTCTGCCGCACCGATTAATGTTAAACTTCCAAGATTTGCCAATCATGGAGATATCATTAATTTCGTTGATTTAGATAAATTAAATCCACTTTAT
CATACAATTGTTACGACATATGATGAAACGACGTCAGTGCAAGAAGTTGGAACTCATTCCATTGAAGCCGTACTCGATTGACGGTTCTTGATGT
TTGATGATAATGAGAAATTGTGGAGATTGTTTGACGGGGATAGTAAAGCACGTTTACGCATTATAACGACTAATTCAAACATTCGTCAAATGAAGA
AGTTATGGTATTTGGTGCGAATAATGGAACAACCCAAACAATTGAACTTCAGCTTCCGACTGATATTTCTGTTGGTGATACTGTTAAAATTTCCATG
AATTACATGAGAAAAGGACAAACAGTTAAAATCAAAGCTGCCGGTGAAGATAAAATTGCTTCTTCAGTTCAATTGCTGCAATTCCCAAAACGTTCAG
AATATCCGCCTGAAGCTGAATGGGTAACAGTTCAAGAATTAGTTTTTAATGGTGAAACTAATTATGTTCCAGTTTTACAACTTGCTTATATAGAAGA
TTCTGATGGAAAATACTGGGTTGTACAGCAAAACGTTCCAACAGTTGAAAGAGTCGATTCTTTAAATAATTCTACTAGAGCAAGATTAGGCGTAATT
GCTTTAGCTACACAAGCTCAAGCAAATGCTGATTTAGAAAATTCTCCGCAAAAAGAATTGGCAATTACTCCAGAAACGTTAGCTAATCGTACTGCTA
CTGAAACTCGCAGAGGTATTGCAAGAATAGCAACTACTGCTCAAGTAAATCAGAACACCACATTCTCTTTTGCAGATGACCTTATCATCACTCCTAA
AAAGCTGAATGAAAGAACTGCTACAGAAACTCGTAGAGGTTAGCTGAAGATCTACGCAGCAGGAAACTAATACAGGTACTGATGACTACAATC
ATCACTCCTAAAAAGCTTCAAGCTCGTCAAGGTTCCGAATCATTATCTGGTATTGTAACTTTTGTATCTACCACAGGAGCTACTCCAGCTTCTAGTC
GTGAATTAAATGGTACAAATGTTTATAATAAAAACACTAATAATTTAGTTGTTTCACCTAAAGCTTTGGATCAGTATAAAGCTACTCCAACGCAACA
AGGCGCAGTAATTTTAGCAGTTGAAAGTGAAGTAATTGCTGGACAAAGCCAAGAAGGATGGGCAAATGCGGTTGTAACGCCAGAAACGTTACATAAA
AAGACATCAACTGATGGAAGAATTGGTTTAATTGAAATTGCTACGCAAAGTGAAGTTAATACAGGAACTGATTATACTCGCGCAGTCACTCCTAAAA
CTTTAAATGACCGTAAAGCAACTGAAAATTTTAAGTGGTATAGCTGAAATTGCTACGCAAGTTGAATTCGACGCAGGCGTCGACGATACTCGTATCTC
TACACCATTAAAAATTAAAACCAGATTTAATAGTACTGATCGTACTTCGTTGTTGCTCTATCTGGATTAGTTGAATCAGGAACTCTCTGGGACCAT
TATACCCTTAATATTCTTGAAGCAAATGAGACAGCGTGGTACACTTCGTGTAGCTACACAAGTTGAAGCTGCTGCAGGAACATTGGATAATGTTC
TAATAACTCCTAAAAAGCTTTTAGGTACTAAATCTACTGAAGCGCAAGAAGGTGTTATTAAAGTTGCAACTCAGTCTGAAACTGTGACTGGAACGTC
AGCAAATACTGCTGTATCTCCAAAAAATTTAAAATGGATTGCGCAGAGTGAACCTACTTAGGCGACGAACTGCGATAAGAGGTTTTGTTAAAACT
TCGTCTGGTTCAATTACATTCGTTGGTAATGATACAGCTGGTTCAACACAGCCATTAGAATCATATGAGAAAAATGGTTATGCAGTATCACCATATG
AATTAAATCGCGTATTAGCAAATTATTTGCCATTAAAAGCAAAAGCCGTAGATAGTAATTTATTAGATGGTCTAGATTCGCTCCAGTTCATTCGTAG
GGACATTGCACAAACAGTTAATGGTTCACTAACCCTTAACCCAACAAACGAATCTGGGTGCCCCTCTTGTATCATCTAGTACTGCTACATTCGGTGGA
```

Figure 12(D)

```
TCAGTTTCAGCAAATAGTACATTAACTATTTCTAATACTGGAACGGCAACTCGTCTGATTTTTGAGAAAGGACCTCAAACTGGAACAAACCCGGCTC
AAACGATGACAGTCAGAGTGTGGGGAAATCAATTTAGCGGGGAATCAGACACAACACGTTCTACCGTATTTGAAGTTAGTGATGAAACGTCTAGTCA
TTTTTATTCTCAGCGTAATAAAGCTGGAAATATAACATTTAATATCAACGGTACAGTAACACCGATAAATGTTAATGCTTCAGGAACATTGAATGCA
AATGGTGTAGCAACATTTGGTAATTCAGTCACTGCAACTGGTGAAATTATTTCTCGAAGCGCAAATGCTTTCCGTGCTATTAACGGAAATTATGGTT
TCATTGTTCGCAATGATGGATCAGTAACGAATTTTATGCTTACTACATCGGGTGATCAGACTGGTGGATTTAATGGATTACGTCCATTGTCCATTAA
TAATCAATCTGGGCAGGTCACAATTGGTGAAAGCTTGATCATTGCTAAAGGTGCTACTATAAATTCAGGTGGTTTAACTGTTAACTCGAGAATTCGT
TCTCAGGGCACTAAAACATCTGATTTATACACCCGCGCTCCAACATCTGATACTGTAGGATTCTGGTCAATCGATATTAATGATTCAGCCACTTATA
ACCAGTTCCCGGGGTATTTTAAAATGGTTGAAAAAACTAATGAAGTGACTGGACTTCCATACTTAGAACGTGGTGAAGAAGTTAAATCTCCTGGTAC
ATTGACTCAGTTTGGTAACACACTTGATTCACTTTACCAAGATTGGATTACTTATCCAACGACCCCAGAAGCACGTACCACTCGCTGGACACGTACA
TGGCAGAAAACCAAAAACTCTTGGTCAAGTTTTGTTCAGGTATTTGACGGAGGTAACCCTCCTCAACCTTCAGATATAGGAGCGATCCCATCTGATA
ATGGAATAATAGGTAATCTTACTATTCGCGATTTCTTGCGAATTGGTAATGTTCGCATTATTCCTGACCCAGTGAATAAAACTGTTAAATTTGAGTG
GATTGAATAAGAGGTATTATGGAAAAATTTATGGCAGAGTTTGACAAGGATATGTCCAAACGCCATTTTTATCGGAAAGCAATTCAGTAAGATATA
AAATAAGCATAGCGGGTTCTTGCCCGCTTTCTACTGCGGGACCCATATGTTAAATTTCAGGATAATCCCGTTGGAAATCAAACATTTAGCGCAGGTCT
TCATTTAAGAGTTTTTGACCCTTCTACGGGAGCATTAGTTGATAGCAAGTCATATGCTTTTTCTGCTTCAAACAATACAACATCTGCCGCTTTTGTC
AGTTTCATGAATTCTTTGTCAAACAATAGACTTGTTGCTATATTAACTAGCGGAAAGGTTAATTTTCCTCCTGAAGTGGTATCTTGGTTAAGGGGAG
CAGGAACTTCAGTTTTTCCATCAGATTCAGTATTGTCAAGATTTGACGTGTCATATGCTGCTTTTTATACTTCTTCTAAAAGAGCTATTGCATTAGA
GCATGTTAAACTAAGTAATAGAAAAAGCACAGATGATTATCAAACTATTTTAGATGTTGTATTTGATAGTTTAGAAGAACGTCGGAGCTACAGGATTT
CCTAAAAGAACATATGAAAGTGTCGAGCAATTTATGTCTGCGGTTGGAGGAACTAATAATGAAATTGCGCGATTGCCAACTTCAGCTGCTATAAGTA
AACTTTCTGACTACAATTTAATTCCTGGTGATGTTCTTTATCTTAAAGCACAACTATATGCTGATGCTGATTTACTTGATCTTGGAACTACAAATAT
ATCTATTCGTTTTTATGATGCATCAAATGGATATATTTCCTCGACCCAAGCTGAGTTTACTGGGCAAGCTGGGTCTTGGGAATTAAAAGAAGATTAT
GTAGTTGTTCCTGAAAATGCAGTAGGATTTACGATATATGCACAAAGAACTGCCCAAGCAGGTCAAGGCGGCATGAGAAATTTAAGCTTTTCTGAAG
TATCAAGAAATGGCGGCATTTCAAAACCTGCCGAATTTGGCGTCAACGGTATTCGCGTTAATTATGTCTGCGAATCGGCTTCACCTCCAGATATAAT
GGTACTTCCTACACAAGCCTCTTCTAAAACTGGCAAAGTGTTTGGGCAAGAATTTAGAGAAGTTTAAACTGAGGGAGCCTTCGGGTTCCCTTTTTCT
TTATAAATAATATTAAAATAAAGGGGCATATAATGGCTGATTTAAAAGTAGGTTCAACTGTAGGTGGATCTGTCATTTGGCATCAAGGAAATTTTCC
ATTGAATTCAGCCGGTGACGATGTACTCTACAAATCATTTAAAATATATTCAGAATATAATAAACCACAGGCAGCTGATAACGATTTCGTTTCTAAA
GCTAATGGTGGTACTTACACCGGTCCAATTACTATTAATTACGGGGTAAATAGTTATCTTCAATTAAGTAATAATGAAACCCCCATTCGAATTCGTT
CTGGTGGCGTACCGGTAATACTCTTGTAGTTGGCGGCTCTTCCGGCGGTATTAGTTTTAGACCTGCAGGTAGTGAAATCACTACTGGACAAATTAC
TATTACACCAGAAGGTTTGACAACATTTACCAGGGCTGTAACGGCTCCATCGATAACTGTTACATCTACTCCTTCCGCAGCATCTGATGTTACTCGT
AAAGATTATGTTGATGGAGCAATAAATACTGTTACAGCAAATGCAAACTCTAGGGTATTACGCTCTGGAGACACTATGACAGGAAATTTAACTGCGC
CAAACCTTTTTTCACAGAATCCTGCATCTCAACCTTCACACGTTCCACGATTTGACCAAATCGTAATTAAGGATTCTGTTCAAGATTTCGGCTATTA
TTAAGAGGACTTATGGCTACTTTAAAACAAATACAATTTAAAAGAAGCAAAACTGCAGGTCAACGTCCTGCTGCTTCAGTATTAGCCGAAGGTGAAT
TGGCTATTAATTTAAAAGATAAAACAATTTTCACAAAAGATGACTCAGGCAATGTTATAGAATTAGGTTTAAAATATGGAGGAACTATAAATGGATC
TTTAGAGGTTACAGAAAATATAACTGGAACTTTAATTGGAAATTCTAGTACAGCTACTAAATTGCAAACACCTAGGAAAATTAATGGTATATCTTTT
GATGGATCAAAGGACATTACACTAACTCCATCTGATATAAATGTAAATAGTACAACATTTATAAAAATAACGGCGAATTACCCGTTGATGCTAATT
TAGATACATACGGGCCCATTGAAGAATATCTTGGTGTTTGGTCGAAATCTACTTCAACAAATGCGCAACCAGCAAATAAATTCCCAGAAGAAAATGC
CGTAGGTGTACTAGAAGTATTTGTGGCCGGCCAATTTGCTGGCACTCAGCGTTATACTGTAAGATCTGGTAACGTCTATATTCGTTCCTTATCTGCT
AAATGGAATGGCGTCGATGGTCCATGGGGTGTGTGGCGTAATGTTCAAGCGTCAACTCGTCCACTTTCACAAACGATTGACCTTGATAGCTTGGGAG
AATTAGAACATTGTGGCTTATGGAGAACAGTTCAAGAGCAATCATTTGATCGCCATTATCCAGAAGAAGGATCAGCCGCACAAGGATTTTT
AGAAATATTTGAAGGTGGTTTATACACAAGAACGCAGCGTTATACTACCCGCATGGGTATGGTTTATACTCGTTGTCTCGCTGCTGCATGGGATGCT
AGTGCACCTAAGTGGGAGGAATGGAAGCAGGTTGGTCATGGCACACCAGCGACTTTCTATGATGGAGATCTGAATGATTTTAAAACTCCTGGGTTAT
ATAATATTTTAGGCACTGATGCCGTTATTAACTGTCCTACCGGTGAAGGTTTGCCCGACTGTTATTGTTGGTTTGCTGGAAGTTAAACAACGTGCTTC
TGGCGGTGCTATTTTCCAAAAATTTACTACTGCCGGAACGGGTGCAACTACTCGCGATCGTATTTTTGAGCGTGCATATACTGGTGGTGTGTGGGGT
ACATGGAACGAAGTATATACATCTTACTCTTTGCCAATTACTTTGGGTATGGGTGGTATTAAAGCCCAATTAGCGGAGCTAGATTGGCAACATTTG
ATTTTGTTCCTGGTAGTATGTTTAGCGTTCCTTTGAACAAAATAAAGAACATGCCAGCAAATATGAATTGGGGTACAATTGACGGAAACTTAGTTAT
GTTTTCTGTCGGTCCTAGCGAACACACCAGCACAGGACGTACTGTTCAGGTTTGGCGTGGTACTGTATCCAAGACAAACTACCGTTATTTGTCGTT
CGTGTGTTCGGTAATTCTGGAAATAGAACTTGCACAGTTCGCCGTGTTGTTCTTGAAGACGGATCACATACTTGGACTGCTCAACAAGATTTTAATG
GTGCTGTTAACTTTGGTAGTTCAACAACGTTTAAATCAACTACAACATTTAATACAGAAGTTAAATTTCGCTCATTGAATGCATTCCGTATGTATGG
CGGAAAATTTGGTACATTTTTACGTAATGATGGAGAGAGTCTTTATATTCTTTCCACCGACGAAGATGATCAAGATGGAAACTTTAATACAAATAGA
CCTTTCCGTTATGAATTAAGAACTGGTGATGTTACTTTGGGTGGTGCTAGTGGTGCTAACGTTTTAAAATTAAAACGTGATTCTCTCACCGCATTTT
TTGGCGGTGATATTAACATTAAAGGCACGATGACTTTTGACGCCGGACGTTTAGGATCACGAGATTATTTTAAATTTAACCATTGGGGTGATAGTAA
TAATGCGCGTGATAATATCATCCAGTTAGAAGACAGCAAAGGCGCTCATTTTTCCACTGAACGTACTTTAGCGACTGGTGCAATTAAGACTAAATTT
TTTGGTGAAATTGAATCCGATGGTAAATTGGTTATTAAACGTCCGGGTGATTCTATTGTATTATCAACAACTGCTAGTAATTCTTTGCATATTCGCG
GTGATATAGACGGGACTGGTAACTGGTATATTGGTAAAGGTGGTGCTGATAATGGATTAGCGTTCTATAGTTATGCTACTAATGCTGGTGTATACAT
TACAAACGGAGGGTATATCGCGTAAGTCCAAAGGGTGCCGAAATGGCTCAGGTCAATAACGTTCGATTATATGTTCATGGTGAACGTTGGACTGCT
AGTCAACCAGGTGATTGGGGTCGTCAGTGGCAAGTGGAAGCGCCAATATTCGTCGATCATGGTTATGTTGGACAGATAGCTATTATCCAATTATTA
AAGGAAGAAGTGTAATCACCAATCAAGGGTTTGTAACTGCCGTCGATCTTGGTATTCGTCGTGTCAATAACAATTGGGGACAAGCAATTATTCGTGT
TGGATCTGCGGAGGCATCGCCAGCGGCTGGACACCCTAACGCGATATTTGAATTTCATTACGACGGTACTTTCTATTCTCCTGGTAATGGTAACTTT
AACGATGTGTATATTCGTTCCGATGGTCGACTTAAGATCAATAAAGAAGAGTTAGAAAACGGAGCACTTGAAAAAGTATGCCGACTGAAAGTTTATA
CATACGATAAGGTTAAGTCTATTAAAGATCGTAGTGTTATTAAACGTGAAGTTGGTATTATTGCTCAGGATCTTGAAAAAGAATTATCAGAAGCTGT
ATCTAAAGTTGAAGTTGATGGATCTGATGTTCTGACAATTTCTAACCTCCGCTGTAAATGCTCTTTTAATTAAGGCTATCCAAGAAATGAGCGAAGAA
ATTAAAGAATTAAAACGCCCTTTCTTCACTAAAATTGCTCGCAAAATTAGTAATTATTTTAAATTCTAACAACAAGGGGCTTGCCCCTTTGGAGAA
AATTTATGGCAGTAGTTCGTGTTCCCGGTTGGATTGGAAGTTCATCCGTAAATGAAACAGGACAACGATGGATGAGTCAAGCAGCTGGTCAATTAAGA
TTGGGTGTTCCTTGCTGGATGAGCCAATTCGCCGGACGCTCAAGAGAGATTATTCATACTGTAAGTGCTAATCATAATTTTAATGGTCAGTGGTTCC
GTGATAGATGCTTTGAAGCTGGCGGTGCACCCATTGTATTCAATATTGTTGGTGATATCGTTTCTTATTCTAAAGATGTTCCTTTATTCTTCATGTA
CGGGGATACGCCTAATGAATATGTTGTTCTTAATATTCATGGTGGTGTTCATATGTGGGGTCGTGGTGGTAATGGTGGATACACTCACTCAGGAGGC
GACGGTAACGGTACACAAGGCGGTCATGTTATTCAAAATGATATCGGTGGACGGCTTCGTATTTGGAACTACGGTGTTATAGCTGCTGGCCGGTGGCG
```

Figure 12(E)

```
GCGGTGGTGGTATTGCATATCGTCCACACTCAGGGGCAAACTGGCAAGATATCGGTGGCGGTGGTGGTCGACCTTTCGGTGGCGCTGGCGGTGGCGG
TTATTCCGGTGGTGCTGCTTCGTATGAAGGTCCGGGTGGAGGATACGATTACGGTAACGCACACTCCGGCGCTGGTGGTAATGCTGGTGCTGCTGGT
CAGAATGCATGGTCTGACGGCGGTAAAGTTCTTAAAGTTGGTGTTGGTGGTGCGTCTGGTCATGCAGTGTTTGGATCTTCTCCAACTTGGGGTGTTG
TTGGAACAATTTACGGACCAAGAGTATAAAGAGGAGATATACAATGGTCTTCACACTCGAAGATTTCGTTGGGGACTGCGACAGACAGCCGGCTAC
AACCTGGACCAAGTCCTTGAACAGGGAGGTGTGTCCAGTTTGTTTCAGAATCTCGGGGTGTCCGTAACTCCGATCCAAAGGATTGTCCTGAGCGGTG
AAAATGGGCTGAAGATCGACATCCATGTCATCATCCCGTATGAAGGTCTGAGCGGCGACCAAATGGGCCAGATCGAAAAAATTTTTAAGGTGGTGTA
CCCTGTGGATGATCATCACTTTAAGGTGATCCTGCACTATGGCACACTGGTAATCGACGGGGTTACGCCGAACATGATCGACTATTCGGACGGCCG
TATGAAGGCATCGCCGTGTTCGACGGCAAAAAGATCACTGTAACAGGGACCCTGTGGAACGGCAACAAAATTATCGACGAGCGCCTGATCAACCCCG
ACGGCTCCCTGCTGTTCCGAGTAACCATCAACGGAGTGACCGGCTGGCGGCTGTGCGAACGCATTCTGGCGTAATGTGAATAAATACCCTTAAAAGG
AGGGTCTATGGCAGCACCTAGAATATCATTTAGTCCAAGCGACATCTTGTTTGGTGTTCTAGATCGCTTGTTCAAAGATAACGCTACCGGGAAAGTT
CTTGCTTCCCGGGTAGCTGTCGTAATTCTTTTATTTATGATGGCGATTGTTTGGTATAGGGGAGATAGTTTCTTTGAGTACTATAAGCAATCAAAGT
ATGAAACATACAGTGAAATTATTGAAAAGGAAAGAAATGCACGCTTTGAATCTGTCGCCCTGGAACAACTCCAGATAGTTCATATATCATCTGAGGC
AGACTTTAGTGCGGTGTATTCTTTCCGCCCTAAAAACTTAAACTATTTTGTTGATATTATAGCATATGAAGGAAAATTACCTTCAACAATAAGTGAA
AAATCACTTGGAGGATATCCTGTTGATAAAACTATGGATGAATATACAGTTCATTTAAATGGACGTCATTATTATTCCGACTCAAAATTTGCTTTTT
TACCAACTAAAAAGCCTACTCCCGAAATAAACTACATGTACAGTTGTCCATATTTTAATTTGGATAATATCTATGCTGGAACGATAACCATGTATTG
GTATAGAAATGATCATATAAGTAATGACCGCCTTGAATCAATATGTGCTCAGGCGGCCAGAATATTAGGAAGGGCTAAATAATTATTTGTTCGTATA
CATTTCTAGATATCGATATACACCCTCAAAACCCTCGTTGAATTCATCGATGAGGGTTTTCTTATCTTCTTGAGTTAATTCAGAAACAATTTTACGA
AATGAATTCTGATTTAACTTTCTACCTTCATGCGTTACTCCAATCTCATTAAGAAATGCAATAAAATTAGCACGATTCTCAACAATATCTTCTCTGG
AAAATTTAATCAAAATAGATGCAACAGTAATAAATTTCACGAACTGTATCAATGTTTTTATTCATTAACTATACCACTCAATTAGTTGACTTTGTTAT
AATATCATCAGACGCTTGATTTGTAAACTGGTCTGTGTTATTTTCTTCAAAAATTTTTTCTATGAATTCCTTGAACGACTCGCGTTCCTGAGCTACA
TTATGCTCGATTACCTTTTCAAGATTATGACTCATTCGAAATAATCTTCAATTTCGTAATCATGGACATAAATCATTATAGTTTCTAATACATCATC
AATACTTTTTCCTGGAGCTGGAATTACGTAAAAATATCCTGCTTTTGAGAGGTCTTTATAAGTTCCAATCAAGAAATCATTATTCTCAAGATGTAAC
TCTTCAACTAATTCATTGACAATTGAATGGTATAGGTTTGGTAGAAACTTATATAGCTTTTCTAGAATATCAATTTTGATTGTGTATTGAACCACGG
ACTGAGAATCAATAATCATAGACCTTCCCCTTATGTTTCTGTTTGCGATTAGATTCTTTAAACGCTTTCTTCTTATCCTTATGAACAGAAGCTTTAT
TAAAATTATGCTTTGCACTAAATTGTTCATAGTGCTGAATTACCTCTCTTAAACATTTGCATGTGAATGAAAACTTTTTAGCTACACCACATTCAA
ATATATGTTCTCTTAAATCGCGTGTATCGGTATATCCCATCTCAACAATAAAATGCCGTATTAGATTTTTATCTTTATCGTTGAGAGAATTAAAATA
ATCGGATTTTGAATTAATTTCCCTGGCCAATTTGAATCACCTTCAGTTGGCGTTTTAGCTCTTTTATCATCTCTTCGTTCATCGCAATATAAAGATC
GCGTAAAGCAAGTTTTAGCATTCCATTTACTGGATAACTAAATGGACATACATAATCTTTTCCTACGAGCTTTTTGGTGAATTCCATATCACAGAAC
TGAAATGCCGGTTCATTTGTATAAATTCCCCAATTAGTTGACATCATTTTATTGGCATATTCCAACGCCTGGATTTGATTCTTAATTCCATCAATTT
GAAACTTTTTAATATTCATTAGTAAAGGTCCTCAGAGTAAAGTTCTTTTGCTTACCACCACGTTCAATACGACCACTTGTCCAGCGTAAGTTGCAATA
ATCATTGCTTCTTCACGTGTCCAGTAATTGCTATACTGGTCAATAAATCCTTGGTCTTCACCACAAACATGGTCTGATACAAGTTTATCACTTACCT
GGTCAAGAACTTCAGCCATATCTTTAGAATAATGACGAGCACCAGGAATAACCAGAGTCCCACCATCTTTTAACTTAAAGCGGTTGGCTGCACACAC
AATTCGACGTTGATATTTTTCATTATTGTTCCAATGAGCTACTTGCCAACAGATTTCAGGAACCTCTTCTAAAACATCCTCTTCCGTATATTCGGTG
TAGTCGCCATAGGCCTGTAATTTAGCTGCTAGACTTTCTGGAGTTTCACGTAATAAAGCCAGGTCTAATAATTCAAGACGCTCTTTGAAGGTTTTCA
TTTGGTTTCCTCAACACTTTTAATTTTTATAGCTTGTTTAGAACTTTCAAAGCATTGACAATATCTTCACCGCATCAAACTGGTTGGCCGCTTTA
AGATGGACTACACCTTCGCCGTTATAAAATTCTACGACAATTTTAAATGTTTTCATTTAAACCATCCTTTAATACGTTGCCATAAAGTTTTCTGTTG
AGCTTTGTTAACACCAATTGAGCGAATAACTGGTTGAGATTCATGGAATTCTTTATAATCAGCAAGATAAATTTCGTAAGCTGAATCCATAAAGGAA
CTTATAGCTGCCATGAAATTATTGCGAATACCTACTGGAGCATCTTTACTTTCACGAATAATCATGTATTTGCCAGTCTTAATCTTTACAATAGTTC
CAAGATAAGCCCCATGGTACCAGATGTCCCACCCCTCCTGAGTGGGTTCTGCACAACGACGAAGTTCATTGACAATTTCTAACTTGTTCATTATTTA
TTCCTCACAGTTCAGATGCTACAGTGATTACAGCTTCAATGTTTTCTTGCTGAGCGTTTAATGTCAAGATACACATTACCGTTTTTAGCGATTTTACA
TGACATTCCGATGTCAGTAAATTTCTGAATATGATGTTCCATCATTTTGTATCCAAAAATTCGCATATTTCCATTGTTGTTAATTTCAAAATTACGA
ATTCCGTGAGTGCGTTTTTCTAAAATAGCGAGATAGTTACTACGATAAGTTTCAACCTTTTTAAGAACAAATCCATTTTCATCTAAAAGTTTTAACA
TGAAGTCTTTATCTTCTTCCATATCAGAAGTAATCTCGCGAGCTTTACGAGTTGCTCGTTTTTCAGCAGTTCAGGAGCATTTTCCTGTGCATATAA
AGTTGCCGCATTTGAAATAATATCCTGAGCTTCACCAGTAATGATTAATCCATCACCAGATTTCTCCACCAGGCCTTTTTAATCAATACCCCAATA
TTACTATTAACTACTGCGTTACCTAAATCTGGATGCACCTCACGAACTTCTGCAGCTGTAATGAAATCTTTCTTAGCAATGGTAATTAAAATCGCAG
CAGTTTTTTCATTCAGAACATCGTTAGAAGCTTTGATGATGTAAGTTACTTTAGACATTTTCTAATCTCCGTAATTCTGTATCAGTAGTTGATAGTT
GTATAGTACCACAGTATGCTTTGGTTGTAAACGTTTTGTGAAAAATTTTTGAAATAAAAAGGGAGAGCCGAGGCTCTCCCTAAAATTACTGCAT
GACTGTGATAACTGTCATGATAACACGTTGAATTCCGAACGCAAGAAGACCTCCTGCTACGGCAGGAACAACACCTAAACCCGCCAGTAAATGCCA
CCAGATACTAATGCAGCGCTTGTGATACCAATGAATGGACTCATTTGATTTCCTCTAAATCTTTGGTGTATTCTGTAACTACATCAGTAGTTTTCCA
ATATTCGTTTCTTCTTTTTTGGCTTTAGTTTCTTCAGCAAGTTTCTTCGTCGGAAGTCATATGAAAATGTTCATTCCAACTAGTTTATCA
ACATAAGAAGAATACATATCAATTTTAGAAAGTTCTTCGGTCAGTTCTTTGCGAGTTTTACCTTGACAACAATTTCACCTGAAATTACTTTCTTAA
TGAAATGTGCCTTGGCAAAAGCTAAACGAAATGCTGATTCAGTTTCTTTGATTTTGTTATCAATTCGTTTTTGGACATAAGTTTTACGAACTTCAAC
GAAGTCTTTGATTAAATCAACTACATTATCGTAAACTTGCAGCTTTCCTTTCTCATTAATGACGGTAATATTCTGGGAACGACGCTCAATCAACCCG
AAGTCTTTCATAATTTTTGCATGACGTTCTTCTTCATTATCGCTCAAAGAATATTCTTTGCGGAATTTAACTTTGAATCCAAAACCATGCTCACCGC
AAGCATCATCCCATGTAATGAAGCCTTTATCTTCAAGTGGGTCTAAGATTTTTACTCACGTAAGTTTCACGATCATACTTTATATGGAATCTCAGTGAT
ATGCATTTGAGTTCGTGAAGTAAACTTTATATGTTCCACGAATTTCATATTGCCCATCAATTTCAACGACTTCACCACGAAATTCTGGGAATTCTACC
TTCGGTTTAGTTACTTTCTTTCCTTGAAGAGCTTGTAATACAGCTTTCTTAACAGAAGAAACACTATGAGGAAGAATGTAAGTTGCATAACCAGTTG
CAATACCGGAAACGCCATTAAGAAGAACAGTAGGAATAATAGGCAAATAGAAAGCAGGCGGAATGTGTTCTTTATCTTGATGTACCGGAGCATATTC
AGTATCTTTATATACGTTATAGAAATTTTTACTTACACGAGCAAAAATATAACGACTTGCTGCTGCTTTTTGGACGGTACGAGAACCAAAGTTTCCT
TGACCATCTAACAGAGGAAAATTATTATTCCAAGTGTTAGCCATCAAAGCACCTCGCGTCTTGCGCAGGTTTTCACCATGATGATATCCAAGGTCCG
CTACACCACCTGCAATAGAAGCGAGTTTGTGAAACTTATCTTTATTTCCTCGTGCCAAATCAAGAGCTCGAGCAATAACAAATCGTTGAACTGGCTT
AAATCCGTCAATCATATTTGGAATGGCACGATTTTCAACCGTGTACATAGCATAAGCCAATGCTTCATTATCAATGATACTTTTAAATCGCGATTA
TTCAGTTGCATAAATTTACCATACTAGTGAATGTAGTGCCATAATAACATCAGAAATGAAAAGCACGACTTGAATTAATCCGAACATTACTCCATAA
TATAGTGCTACTAATAAAGCAGCAAGGGCTAATGAATAGCCCAAGATTTTCTTAATCATTAGTAGATAACAACACAAATGTTAAATATGCACACATA
CCCTGGGCTAAAGCTTGTGAAAAACACACTGCTAGCATCGATACAGATAGTTAAAACACATGCTACTATCCAACAAATAAATGAAATAACTCCTAATA
ATTTTGCGATATTCATATTTTCCTCACTGGCGTCCGAAGACGCCTTTGTTTTTAAGATTGTTACGATAGAACTGCATCACATGTTCGTTATGGAAAT
```

Figure 12(F)

```
TACTCATACACACCACACATTTTGCATAAACGTTCAAAACAGATAAATCCGCCACCTACACACATCACGACAGCCACATTATCATTAAGAGGTAGAC
CTAAAGCCGTAAAGATTCCAGTCAATGTGAATAAGGCTAAAACTAATAGGTAACCCATTACAAATAGAGCTTTCATTAGTATGCCTGCAAAACAAAT
TTAAAGTTATCAGCCAACATACGGTTCATTTCTTCAAGTGTTTGATACTCAGAATGATGATTACGAGTAAACGCTAAAGCTAACTGACCTTTTCCAA
ATCCTGTCGTCAAAGGTTTCATCTTAGAAGCAGGAAGATAAAATACTGCATATGGAACATTGTTATTTGCAATAGTACGCGCAAGCTGAGACCGACG
TTGACGAATATGACTTAGAACTGCGCTGAATCCTTGCTTAGAACGTTGATTACCTACATAAAATCGTGCAGACACACATGGATTACTAAATGGACGA
CCATCTAATTTACTTACTAAAAAGTAAAATCCAGGTTTAGATAAAATATCTTTATGCGGAGTTCCCAAAAACCACTCACCACCCTTGATTGTACCAA
TAACAGTAGCACCTGCATCATTCAGATCAGTAACAGTCATATATTTCATATTAATTTCCTCTAAATTATTTTCTACTCCAAGGCCGCATGAATACGC
GGCCATTAAATTAATCGTCGCAGTCGACGCTCAATTCCCAAAACTCTTCTACGGTATAAGTTTCAGTATCATTTTCAATACAGAAACGTTCATTACT
GTTATTTGCTAAAGTAGCGTTAACTGTCATTTTCTCGCTGGTGCTCTTAAGAGGTGAAATACGAATTAACTGATCACCACTATCCAAGCAAAAAATT
TCACCAACTTTTACATCTTTAAAGATTTTCATAATTCACCTCAAGGAGTATAAAATCCAAATGCAGTTGTTGACCATCCCATCCAATATGGAAAATT
TGCGCCAATGTAAAACATAAGAATATAAAACCAACCACTCAGCAAATTCATCATTTTACACCATTCCAAATTGTTTCAACCACGGATTTTAAACCAT
TTTGATGAATATCCATTCCGACTACCGTCATCAAATAAATTCCAACTACAACTGAACCTAAGGCAAAAATCAGCATGAAAATGAATAAAGCCGGAAA
AATATTATCGAAAAACCATTCAATAAATGTAAAAGCACTGCGTTTACGCTTCATATTTTCCTCACATAAATCCAAAGTAAACGTTTAATACATCAAT
CATTAAAACGATTGGGAATATACTCAAAACTATTAGTATTATAACTACATTCCATATAGCTTTAACAATCTTTTTCATTTTCTGTTCCTCCGTAGTT
GATAGGGTAATAGTACCACGGAAGAACAGTCTTGTAAACAACTTTTTAAAAAATATTCGTAATAAATGTGAATACCAATCACCACTGCTGAAACCTGT
GCAACCCACCACGCACAAGCAATAAGTACAGAATTCAAAATTTTCATAATAACCTCATCACAAAAGTAAATGTTAAACAAATTAATGGAATACTAAT
TAACCAAACGAAACACCACCATAATGAACTCATAGTTCAATCTCAGCAATTTTCATTTCATTACTATTAATAGCCGCTTTAAGACTATCTGAAAGAA
TTACATTCCAGTGGTCATTCATATGACCATTAACTAAGCGTGTAATTTCTTCGGGAGTTGAAAAATAAGGCGTATCAGACTCCCAATGCGATAATCC
TAAGCGAGTATAAATCATACCTTCATCATCGCTAGAATATTCAACTGACACAAACTCATCAGTTATTTTATGTTAGCGTAATAAAATTTAAATTTC
ATTTTCCGCTCCTCCGTAGTTGATAGTTGTATATTACCACGGTCCTTGTGGTATGTAAACCGTTTTGTGAAAATTTTTAAATGGAAAGATACCATCC
GTTGTAGTTGCTTTTTCTTACAACCTTACGAAGGTCTTCTCTGTCACCGATGAACTTCGGAGTGTACTGGATGACACCTGGGTGAATTTCTTTAGTG
TTGAATATAATTATACAGTCAGCGACCTGATGATTCAGAATGGGCCCTAGATTTATTCCAGAACCATATGGATACTCTCCGCTGCATCCTGTTGTTA
CAGAAATCCAACGTGAGTCAGTTTGATGTGTCTTAACTTCTACACGAAGCCCGCAGTATCTTGGATGCGCAATACATCCCATGCGTATGTATACGG
GTCATTAACGTCCTCTTGGCCTTTGTTAACATACCCGCTTAGCCAATCTGCTACAAAAAACTCTGCGTACACCGCGATACGGCATCTTTCGATAACT
TCTGCCTTATCCTGATTTGGGTTTTGTTTAAAGAGTATCTTGCTGTATCAGCAATTTTGACCTTCATTTCACTAGTCAAATCACTGTTCGATAGGG
TAAATGTCGGAATCTGAAATAGTCTCTGTAAACCCGGATTCGTTTTCGACATTTAGACTTTCCTTTTTACCGCTGAGATAAGCGTTATATACTTTAA
GAGTGCCGTAATAAATTCGGTCATTTTCATCTAAAGACTCACGGTCAAGTTCATCGAGTTCCTTTTTATCCATGACTATAACATCATTGCAATAAAG
AAACCCAAGTTTTTTGTGTCCAAACTCAAATTTATTACAGTACACAATATTAGCGTGATGATTACCATGTAGAGAAATTTCTTTTATGTCGGAATCA
CCGATATTCATCAATAAATCATAATTCACCTTAAAACAAAAGGGCCGAAGCCCTTATTTTATTTGAATTGTGCAATTCTTTTCTCTAAACAGTCAG
CATAAGATTTCATTGAGATAAACTGCGAAAGTAACAGTTCTTGCTCAACTGCACTAACTGTTAGAAACTTTGCGCTTTCTAAAAATTTGCTCAGTGC
ATTAATTTTGAGCATTAATTGATCGTATTCTTCTTTTACTCGTGCTTGATAACCTAACATAATTTTCCTTAGTTAAGGGCCGAAGCCCTTATTTAAA
TTGTTCAGTAACGTCTTCAACTACTTCGTATTGACAGGTACGCATTTTAGCATCGTTGTAATCAATCGGAATTGATACTACATCACGCGGATGTACT
TTAACTTTTACAACTCGGCTGGTTGAACTGCCAAAGTGACGAATATAAGATTTAGAACACACATGCAGACCGCGAGAACAAGTTTGTGTATCATCGT
CATTCACACGAGTACGTGGCATTTTAACTACTTTACCAGGACTGTTATCAAAAGTATTTGAATGACAGTCAAAGTAGTTGTCACGAACTACTTTCCA
AGCATAGAAGTAACCATCTTCGGTGATTTCAATATCGTTTGCTACCAAGAAATCAAAGAGTCAGATACCGCTTTCTGGCTTGGGTTTTCCAGCAGA
TTTTCCAAGAACGGAAAATAAAATTCAAAGTTTTCGCCTTTTTCCCATCGAATCAAGAATACGATCAACCAAACCAGACCGCAATTCAATATTTTGAT
AGAATAAGCTTCACCTTCAATTCGAACATCGCCGGAACATATATTTTCAACAGCGCGACGAACATTAATTTTTTTGTGCCGCTTCTTCCAGCTTATC
CGCTACAAGCAGATTGAGAATTTCCTGGAAGTTTGAATGAGTATTAGGTGTTGCGTTATAAGTTACACCGTCAACAGTAATTGAAATGAATTTTTTA
GATGCATTCCAAATAATGTCAGATTTAGCAACTGGAGCAATAACTGCATCGCTATTAACTTTAACTGTAATATCACCGCTAATAGTAACTTTAGAGC
GTTTAGCTTCTTCAGCATTTTTCAAAAACACGACGAATTGTGTCAACCGATACACCTTGCCAATCAGCCAATTCCTGTTGGGTGTAATTACCACTTGA
ATACAATTTAACAATTTCAGCTTGTTCGTTTTTGGTCAGGCATTTAATATTGTACATAATTTTCCTTATTAGGCCGCAAGGGCCTTCATAGTTTTAG
CGATTTGGGAAACTTCATCATCATTTAAAGAGTTGCGATAACCGATGAAGTCGGAAACAATACGGAATTTCTTGGTAAACTCAGCAACCATTTTATC
ACTATTTTTTGAAGCATTACGTGATAATTCATCAAAGAGATTAGTTACTGTCCAGATATCATGACCGATGGTATCTTTTCCACCATTGAAATACACA
CCGCGTAATGAACTAACCATATTACCAAGTCGTGTATATTCTTCAGAAACTTCGTCTGTACTGAAGTACTTCATCATAAAATCTAGTTCAGGATACT
TGATAATTTTATCAATATATCGTTGAGCTGAACTTGAATAACCTACATACTTATCATAATCTACATCATCAAAAGCATCTACATATAAATCACGCAG
AGTTTCAAAAATACATTGGCACTGACCGAGTTCTTTTACCTTTTTCTGCAAAAGCGGACGAATAACATAAAATTCATTAATGCCAATAAGATTAGCC
ATACGAATCAAAATATTCATAGATGGATGACAAAGAGATGTAGTACCATCCATAGAGAAAATATCAGAACGATGCATATACCCAGTAA
TTTCATCTGCTTCTGATGTGAGCGTAAATAATTCCTCTTTTTCCCAGCGCCCGTCTTTAATTTCAAACTTAAATGCTGTAGCAGCTTTAGGACGAGG
AGCTTTACTTTTAACTACCTTTGGAATATAGCTTTTAACTAAAGCTTCAATTTCTGACAAATAATGAATGTTAACTTCATCACTTTCAAACATCGCC
ATAATATCAGGAAGCAAATCAATCTGCGATTCTACTTCTGGATTAATAAAACAGAAGGCGCTCATTGTGATGAATATTCAAAGTGTTATTAAATTCAC
TATCATCTAACGCATGTGCTAATCCACGGACAATATTAACACGATTTTTAATATTATCAATAACGATATTAATTTTTGTTGTATTAATACCAAACAG
ACGATAACTTGATGCAACAGGCTGAAGTTTCATGACTTTGCTTAATGCGTTTCAGTCGAGGGTCAAGATTTACTTCATACACCACGCCTGCATTGCAT
AACTTACTATCAGGTTCAAACATACTCTGCATCTTCTTATATGACAGATTTTAGTCGTGAATTTGACTGAATTACTAATCATATAATCTCGAGCAG
AATACCCCATCTTCATTAATTCGCGATATGTATGACGAGGAGATGTAGATTCTTTAAATCGTTTTACATCTTCATTAAATGCTTTCTCACTGAGTTC
TTTAACTCGTTCAATAATATTTTTACGAGTACGATCATCCAGTGAAAGAGCCTCGCGAGATGGAGCAATATCAAGTGAACCCATTGGAAACTTAATG
TAATTCACTTCATTGCGAATGCTTAGCCAGTTACGGTCTCTAATAACACCATCGATAGGATAAACAATACCGCCATAGATAGCATATAATCCACCAC
GATCAGGCCAGTATCTTTCTGGATTTACACCGTAATAGTCATCAAAATCCGGAAAATAATCAATTTCGCGGTCAAGACCGTTAATGATAGCCAAATC
TTTGAATGGTCGCATGATATAAGAAACTTCATAAGCAAAGTTTTCTAAAGTCTTTTTCTTCAACTGGAACTACGATTTCAATACCAGTTTTATCATCT
GGACCCATTTCTTTTACGAATGTAGGTTTAATTTGTGGACCATCACCATCCATGTAAGCTACATAACCACGAATTTCACCTTTATGATACGAAGTAA
TACTAAATGTATCAGTATAACTAAACGGAGATTTAGAACCTAAACCAAACCCGCCAATAAAGTCATTAGATTCAGCCTTAGATGAACTGAAGTATGA
ATTATATAACCCAGGAGAATTATCATCACCCTGAATATCAAAATCACTCATACCCGGACCAAAATCTCGACAAACAAATCGCGGATCTAATCGTCCT
GGAACTTGTATGATAAATTTTTCAGGATTTCCATTAAGTGCATGGGCATCAATCATATTAGTAATTAATTCACGGACTACTGCACGAATCTTGTTTG
TATACAAATCAGATGACAGAATTTTAAATACTTTAGGAGATGCTGTGATGCTAAATGCTTTTGATTTAGAACCATTGCCAAGAATTGTTTCTTTTTC
AGTGGTGATAATCATAATTTCCTCATTAATTCATATTACGCTTAATAACTTCAGCACTTCTAGTAATTCATCTTTAGTTGCAGTGTCGGATTGAAT
TTTATCTCTAATATCTTTAAAGCGGTTTTTAAATTCTTCGGCTTCTCCCATATCGAAAAAGCGTTGAATGATTCTATATTCTCGATGAACTGCTTTA
TCAAAAAGTTCTAAATTTACTTTATATGATTTCATTTCAATATCCTCATTTGCCCAATTAATTATACCACATCCTTGTGGTAAAGTAAACTACTGGC
```

Figure 12(G)

```
TCATCCATTCTTTACGAAGGTCAGCATTATCTCCCATGAGCATTTCAAAAAGCTCTTTCCAGTTCTCAGGAAGTTTAACAACATCATATACTGGATT
TTGAATCATCTCACGATATTCAGATTTTTCCAAAGAGCCAAGTCCTTTAATATAACGGATGCTATGTTTAGGTAGAGCATCTTTAGCACTCTCATAT
TCAGCGACTGTATAAAACCATTCTTGTTTTTTACCGACCTGAGCGATGATTACAGGAGTTTTGACAAAACGAATTCTTCCTTGCTCAAACAGTTCTG
GCCAATTACTAAAAAACCCGAGCAGAGAAGGATAAATGCTTCCTAGACCATCATGGTCAGCATCAGTCATAATAGCAATATTATGATAATTCAAGTT
TTCAGCTTTTTCACCGAGAACTAATCCAGTGATTGCGCAAATATCAAACAATTCTTTGTTTTTAAGCATATCAGCATATGACATACCCCAACTGTTG
AGAACTTTACCGCGCAATGGATAACCACCATGAAGTTCTTTATCACGAACATCAATAAGATATCCGATAGCAGAATCACCCTCAGTCAAGAAAAGAG
TAGTGTCAGCATCTTTACCGCAAAGATTCGCTTTAATGTGTTTATGAACCTTAGCTTTAGAAGCCTTTTTAGCTGCTTTAGTTTCTGCTGCCTTTTC
TGCCGCCAATTTACGAGCCAAAGCAGCTTCAATAATTGGCATTAGAATTGCTTCATTATTTAGAATAGCACGTGAAATCTTTTTAGCATCAAGTTGA
ATATGACTACGGATTTCGCCAAATGGAGAAGTCAAACGCTCTTTAGTTTGAGAATCAAATCGCATGTTTTCATATCACGGACAAACATAACGATAG
TCAAACATTCTTTAACGCGTGCTTTAGTCACATCAATTTTGAACTTACGTTTGATTTGTGGAATAAGGTCTTCACAAATATCATCCATAACACAGTC
AATGTGATGGCCACCATTCTTAGTGTGAATGTTATTGACGTATGTTAATTGACGAAAACCATCCGGTGAACGACCAACCGCAATAGAGCAATTTTCT
TGTTCTTGAACAATAGCATGCTCATCATATTGGCGTGCATATTTCTTAAAATTGCCCTGAACCTTTTTACCATTAAAGGTAAATTGAATATCAGGAT
AAACTACTGCAAGTGTCTGGAGACGATCTAGTGTAATGTCAAGATAAACTTGGGACAGCTCATTAGTTTCAAATGACATAAAATCAGGAATGAAAGT
AACACGAGTTCCTTTCCATTTTCCAGGAATAGTTTCCCATGATTTATTTTCCATGCCATTTGAACAACGAACTACAATATTATTTTGACCATCACCA
GTTTCACCGACAAACATCACAGAAAAAATGTTTGTCAAACTAGAACCAACACCATTCATACCGCCAGTGACGCGTTCTTTATCATCACCGAAGTTAC
CACCTGCTTTTGGAATAGTCCATGCAGCAACAGGACCAGGAATTTCTTCACCGGTAGGTGTTTTAACCATCGCCTGCGGAATACCACGACCGTTATC
TTCAACTGTTACTTGATTGTTTTTAATAGTAACATTAATTTTATTTGCGAATTTAAACTTAGTACGAATACCTTCATCTACTGAGTTATCGATAATT
TCATCAATAAGCTTAACAAGACCAGGTACATACTGAACACTTTCCCATTTACCAAACAGAAAGCGCTCATGCATTTCATTAGCAGAAGAGCCAATAT
ACATGCCGCTACGCTTTTTGATATGTTCAATATCGCTCAGAATTTTAAATTTCATTCTTAATCATCACTTATCCTCGTTTGGTTTCGGGAATATTATA
CTCCGGTAATCATAAAGCTAAAGGCCCGAAGGCCTTTTATTTAAAACGGATAGTCGAATCCTTGAAGAATAGACCAGAACACACGGTTCCTTCTACT
TTCTGCCCAGTAGGTCCAATAGCACGAAATCCAGTATGTTGGAAATCATTTTCAGAGCAACCGAACCAGTTGTATCCAGTGATTTCAATATTAGTAA
AACCACTTGAAGATAAAACTTTGGTTGCATTATCAGCATCAGTACATCCTGCTAAAGACACTGCTAATACTAATGCTGCGATAGAACGATTAATATA
TTTCATAGTTTTTCACTTAAATTTAATGGCTTGAAGGAGACTAATAATTCTCAAGCGACTTCTTTCATCTTTAACCGTAAATGAAAGAGGGTCACCAG
ATTTCATAGTGATAGTGCATTCAAAATCAAAACCTTCGGGGACTTCTTCGAATAGGTCAAATTCTTCATCATATATTAGAACATTACTCTGAAAACT
GTGAAGAATTTTTCCATCATTTCCAGATGCTGTACTAATCATTGTAACATTATTACCTTTCATATCTTCAACGATAAATTCGCTTGTAGATATTACG
GCATTAATAGAACCATTCCTATAAATAGCAGAAAATAGATATTTCTTCACCTTCGCGAATGCGATATTTCTTACCAATTTTAAACATAATTA
CCCTTTAAGTAAGTCGTAAAAACCACCATTCACATGCTTAGGAGCGGAAACTAACCGAATAGCAATCCGATGACAATCAGGACATACATCAGTATCC
CTTTCAGAAATTTTCTTGATTTTTTCGTATTCTTTTGCACAGTCTTTGGATTGACATTTATAATCATAAAGCGGCATAATTATTCCTTAAAGTGTGC
TTTCAACATCTGATACAAGGACCATGCTTGTTCATTATTTTCAATAGTAACGTTCATAACCGGGAATTCAGATGGATCAGTTATTGTTGCAGATTCT
TCCTGCTCTTCAGCTGCCTGGTATGGATTTTCAACTTCATTAAAGAATTCAGCTTCATTCGATGAAAGCCAAATAAAATCTTCATCCAAAATATCTT
TACCAGAAGATAGTACTAAATTTCCAGCAAATGACATAATTTTAATAGGACGCCCAAGAGCATCCACATCTAAAATTTTAAAAGGATGCATACCTAA
ACGGCGTGCATAGATTCCGTTATCAGTATGGTCTTTAATAAAATTTTCTTGAGCTTGTTTATTTTTAAATTGATACCATTTATTAACTTCAAATTTA
ATAGCCATTAATAAATTCCTTCCAGTAAGTTGTACCATCTTCAGTGATTTCACGAAATACACCGTAAATTGGTTGTTTATCCCCAACCTTTTCATA
CACATAAACCGAAGTCAAGTGAGTAAACTTAGCAGTGTGTTCCTTTTGAACTACTACCAAATCTGGATCGAATAACACATCTTCAAATTCGTCATTA
GTGCAGTTCTGAACAATTTTACGTTTCATTACAATTTCCTCGTTAATTGAACATTGGAGCGATGCGTTTCAGAAGAGTAGCAGCACCTTTGGCAAAT
TTTCCATTTTATTCTCCAAATTATTTTCTATATCAGTAGTTGATATTGATATAGTACCATAATCAACTACTGATGTATATAGTTTTATGAAAAAATT
TTAAACTTTATGCATAGCGAGCTTTGCTGTAGTGTTTAATCCAACTTTCAGGAATGACTTTGTATGTTCCTAAAAATACCGCGTTGTATAACTTAAC
GCCATCTTCTACCCATTGATCAGTAATGTATGCACACATAGCGCGAGTACGCCGAGGAAGTGGTTGTCCACCTTCGATAAATTCAAACTCATAAGGA
GCAATGAACTTGATAGCTTGACCGAGTTTCCACTTAAAGTCTACACCTACATGCGAAGTATCAATCGTTTCAATTCCTTTAGCAGGAACAGCTTTCA
AAAACGCAGGCTCAAGAAATTTCCATCGAACATAACCAAACTGAGGTTTAGACTGCACTTGGAGTAGATACGCACTTTTACTTCAGAATCTTC
ATCTTTAACGCCGTGTTTAAGCTGAATGCTTACAATTTCGACCAATTTTCCTGCTGCTTTAGAACGGGATTTATCAGATACACGAGCAATTTCACCA
ATATTAATAATCATAGTTATCTCTCACTTGTTAAAAGATTTTATACTCCACAGGACCATTATACTCTGGTCCCAAGAGTTTGTAAACTATTAATTC
AAAATAGCTACCACCGCACTACGAGGTACTACACTAAAATCTCCTGCATGGACAACGTTCAGAAGCTCAACACCATCTTCAATCCACTGGTCTGTTA
CCCAACCACAGATAGGATTATCAAAAGGACGACGGATAGACACAGCAGCACACAACAGGTCTGTAGGGTCTTGTTCTTCAACTTCTTGGAACAGGAT
GAACTCATCTTCATAAACCAGGTTTTTCTTTATTTTGTTATTATCTAACCGGCGACCGTGGATGACGTAAGATTTGTCAAACCACTCACTTTTGGCA
AATTCTTCAACAATAAATTCGCCTTCGCCAAAAACATCAGTCAGAGTTTTATGACCAGAATCAAGGCATTAGTTTTAATTTTAGGTTCAACCAGTT
TGTAGGTTTTGCCGATTTCAATAGCGGTAGTCATAGTAGGTTCCTTAATTTCCAGTGGTTTAACAGGGCATACATAAGTACTTACAACGTCAAAATC
AATCAGTTTAGCTGCCGGATTCGGTGTGTATTCAGGATTATAATTAAATTTCATAATTATCTCATTTCAATAAAATCTACAAGTTCAGCATGGGATT
TACGGAACATTACTTGATGCCCGCCAACGATAACTTGGTCATCTGGTACTTCGTATACAGCAAGATAAAATCCTTTAGAAGATAATTCTTCCCGCTC
TTCTCGTGTGAACCATCTCATCTATCATATTCGCTAGCGAAAGCAAAATGATAAAGAGCTATAAACCATCCTGGAATATGATATTCTACTCCAACA
TAATCTTTCTTGAACTTAGTATTAATTACTATATTAGCGTTTTTAACTAATAGTTTATCTTCGTGTGGTAAAGGAATTCTTTTATTATTATCGCTAT
GATGCATAAAATTAGGTCTGTCATAACCTACATGTAATAGCCACTCTTCGCTCCATGAATCTATTATACTCCTGTACGGCGTTATTTGAACACAAAG
ATTTCGACGTATTGTTATAGCATCTTCATAATCAAGAATACTAAACGATGATTCAACACGATAAATTTTCATTTTATTATCCTCAGTAGCTATGGTG
TTATAATACCACAACTAACCGAGGAAGTAAACAACTTTTTATCGTTTTGTTGGAAGAGATAGAGGATCGCAATCTTCCTCTGATGGAGCATCTTCAA
GACCCATAGCATATCGCAAAGCGTACTTCATCATCAGAATATCTTTCGCACAGTCATGAATAGAATCATGCGCAACGAATCCATCTAAAGTTCCTTT
TGGAAGAGGACACGTGGTCATATCACGAACAAGCAGAAGTGCTTCAATTCTGGTACGAATATCACGCTGATTCCAGAATTTACATGGTTCTAACTTA
AATGTGTCAAGCTCATTCTCAGAAACACCATTAAGACGTTGAATATCACGAATGAGATCGACTAAAATTGGAAATCAAACGACATTCCACGGCACC
AGCCTTGAGATTTCCAAGGATCGATATTATGTGCATTGATGTAATCATTAAATTTTGCAATACCATCGATGGTGCTTACATCTTCATCTGATGGTGC
AATATTTTTCGAGCTTCAGGAGACTGATTTTTCCACCATTCGATAGTGCTTTTAGTAAAAGACGATGTCCTTTTGGCTTTTAAATCAAATTTG
ATTTTAATGCCGCGTGAAACTAATTCATCAAATGTTTCAACTACTTCTGGGTTAGGGTCAAAAGCAATTACAGCTAAATCAATAACAGCTGCTTTTT
CACCACTTCCCATTGTTTCAAAATCTATAATAAAATCAAACATTAAATTTTTCCTTGCTAAATCGCGAATTTGACCTACAGTAGTCTTGAATATAA
ACTTTATTAATAGGTTCATCAATAAATTTTGCCATAGATTCAATATCTTTTTGCATCTCTTCAAGACTGTATATTATCTTTAAAGCTTTTTCGCGAA
TAGTAATATTTTCAGGACCAGAATTTTTCTCAATGACAGCTTTAACATTTGTCATAAGAGATTTAAACTGACACCAACTTAATTCAATCATTAATAA
CCGCCTTATAAAGATGGCTAATTTCACCTAAAATGTAATCACTGATTGTAACAGTTTTTACTTCACCACAAAAGAATTCTAACGCAATCAAATCTCG
TTCAATTTCTTCCAATTGAAGCATTAACTTGCCTGATTCAATTTTCACGTTTTTGCGATTTTTACTATAAGCTATTTCATAAATTTCGCTAACTTTA
TCCTGAAGAAGATAAAACTGATCTTTAGTTATTTCCACGAATAGCTTCCTCAAATTTAATTAGTAATTTACAGACACTTTCATCTAGTGTAATTACC
```

Figure 12(H)

```
GTATCTGTATTACTGTGATATGATTGTTTTTCAATTCGTTTAATTGCTAATATAGTATCACTTATAAGATAAAGCTTATGAAGGAGCTCAGCTCCTG
TTACCATAACATTAAGATTATCTTGCTTATTAGTATGCTTCCTTATACCATCTATTAGACGATTTAAATATTTTGAATTGATGTTAATCATATAGCC
TCACACATAAAACACATCATAACGACCACGGGTAACACCAACATAAAGAAGTTGTTGGGCCAATTCAGCATCTGCATAATGAATACAAGGCGTATAA
ATGAAAGCACGGTCTACAGACATACCCTGAGCTTTATGGAATGTTGATGCAGGAAGTGCTTTCACTTTACTAAACTGTGATTTAGCATCCCAAAAAT
CACTCCATGGAGCTTTTCCGCCTTTGTTCCAATTTTTATAAGTTTCTGCTGTTTTACCTAAAAATAGATTAAACTTATATAACTCTTCATCAGATGA
AATTATTTTAATCTTTTCACGATAATATTCATCATCGCCGTAAGTTTCTACTGTTAAATCCCAATGACGAATTAGATATTCCCCAGGAACACCACGA
GCTTTAACAAACGTTGATGTATACTCAGCTTCTATAATACGAACTAATTGTCCGTTATTAAAAATAATTTCTGATACAGGCTTTCCCATCAATTTTAT
ATGTTTTAATTAATGGTTCCTGCATTACAATAATTTCACCAACAATAAAATCTTTATCAGTTTCAAAAATCTTTTTACGAATAATGCTATTTAACTT
ATCAACAGATTTATTCGTAAATGCCATTACGCGATTTTCAAACAAATCATCTAGTGATTTGACGATTGAAAAATAATTTACCATAAAATCGCGTAAA
GCGGTATCACCGGTAAATCCACGTACTCCATGCCCGTCAACAACTTTATCATAAATCCACTTACCGTTACGAACATCAGTAGCTACATCAATAATAG
GAGCATTACTGCGTTTAACTTCAGTAAGTTCACACTGATAAAAATCTTTGTGTGTAAAGAATGGACTGATATAAGCAGTATTTTCTCCTGGGTCAAC
AGGTCTAATTTGCTTATTATCACCTATTCCAATTATGGTACACCATGGCGGGATAGTTGAAAGCAGAATTTTAAATAGCTTTCTATCATACATTGAC
ACTTCGTCGCAGATTAATACTCTGCATTTAGCTAAATCCGGTACTTCTTTTTGTTCAAAAAGAACGTTTTCTTCATATGTTACTGGGTTAATTTTAA
GAATGCTATGAATAGTACTTGCTTCTTTCCCTGATAGTTTTGAAAGAATCTTTTTAGCCGCATGAGTAGGAGCTGCTAAAATAATACCAGTTTCACC
CGTAGATATTAAAGCTTCAATGATGAACTTAGTAAGAGTAGTCTTACCGGTACCGGCAGGTCCATTAATAGTTACATGGTGTTTCTTTTCTTTAATA
GCCTTCATAACAATGTTAAAGGCATTTTTCTGGCCTTCGGTCAAATCATCAAATGTCATCGTAAATTCCCTGCAATTGGTATACTAACAATACGCCC
AGTATCTAAAATTCGCTGATATAATCTTTGTGTGTCTACGTCGGGCTTAACATGTTTAACTTCTATTTTATTAAACCAAAACTTGCGTGGAGTCTCA
ACTAATCTTGGAATTCCCTTACCTAAAGCTAATCGATACTGCTCTTTAAGAGTGGTAAATACTTTATCAGCAATCTTCCATTCAAAAAATACAGCAG
GACGATGTTCATCAAGTGGAACTGGCGCAATAAATCCATCTTTGTCTCGGTAAACTATCGCATATACATAAACCATATTATCCTCGGATAAGTTTAA
AAATTGAACAATTTAGCGGATATCCTCTTTTCAGTTTAAGTTTATCAATAAAAGACAAGTTTTGATACCGCTCTACACCTTGAATAATTTTATCACA
CATATCATATTGCATTTCTGCTTCTGACAACTTTTTCACAATTTTCCAATCCGAGCCTTTAAGAAGAACGTTCAGTTTAACAACTTCAGCGCCTTCT
GCTATGCGAGAACCATCAATACGAGCTTTAAGTGCTATAATCCTTAGCTTAATGTCAGAGGTTTGTTTTGATTTAGAAAGCTGTGAAATGTGTTCAA
TTCGGTTTTCACGTTTTTTCTGTATAGCTTTAATTTGATTATAGGTCTTTTTGATTTTAGCCCATTTCTTTTCATCTAAATTTAGTTTATGAACTTT
TTTCGCAGATGAACGACCAATTCGCAAAGCAAATAAATCACGCTTTTCAATCAACTCCTCTAAAGTATAATCAGAACGAAATGTATTATACTTTTTC
TTTACTGCAATAACATTCCCTTTAATGTATCCAATGTTATTATCAAAACGTTCTAATGATAATTTCTCTCCTTCAATACGATTATCAAAAGGTTCTC
CTGAGTAAGCGCAAACTTTCTGATCTAAAATGTTCTTAATGTAATTGAAGTCTAAGTTAAAATCTTTAGAACGTCTTTTAGCAGATGCCTGAGTGTG
CTCTAAACGACGTTTAATTTTACGAATTTGATTATTAGACAGTTTCATATTTTTCTCACATCTTACGGACGATTTAATACTTACTATAACATTTTTA
CTTCAGATTGTAAACAACTTTATGCAAAAATGCTTTAAAAATTTCATGGTATAATGAATCTAAGTCCTTCCATTATAGATTAAATCCTTCAAAGTCA
AGAGTATAGATAGTGTATGTTGAATACTTTTTATACTCATATCTATCTGCAATTCTAAATACACTTCCAGCTGGTATCATTACTTCTTGTTCATCTG
AAACTAATTCCATATTACGATAACGATGGCTATCCGGAAACTTAAAGTTTGGATTGTATTCTTTACAGCGTAGAGCTTTTATAGCATACTCCTGGAA
ATTGAATACCATAGGAGCTTTGAATTCAAAAATAACCTGTGTGTTTACAAACCGGAAGCAAAATGTATAGCTATATTTTTATCATATGAAGCT
GATACGACTTTATCAAATGTAATAATATCAATTCCTTGATTTAACGCTTGCTTAGTCTCGACTGGAACACCTCTCCAAAGAGGTTTATCGTTTGGAA
CCAAACGAGATTTGACTATTTCATTTAACCAAGAATGATCGTCTGGTTTATTAGTAATACAATGAATTAAAAGTTCAATTTCAGATAAATTAAATCC
TTCAGAAAGTAATTCTTCACGAATAGAAGCACGCACCGATGCATCCATTGATTTTATTTTAAAATCTTTTAGTTGCATTACTGAGTATTTCATTCAA
CTACCTCAATATCATAAACTTTAAATGTTCCAAATGAATCGTGTAATTTTTCTTTGAAATAGAAGTTATTTTATACTTTCCAATTGGAATCATCCA
TTCTTGTTCACGTACAATCATCATTAAGTTATCAGTACGTTCTGAATCTAATCCATCAGTATCTTCATATGTATACTTAAATTCAGTATTAGGAGAA
GAAAGTATAATATCGCTGATATGGTCAGAATAATTAAAAGCTTTATCAGTTTTTAAGCGAAATATTATTTCAGTGAAATACTCAACATAAGAAAAAC
CACATGCTGTGCGCAAACTAGTAGTAAATGAATCTACTCGTTCGTTGAAAACACTTCTCCAACTTGTAAATCTTTAATGAGTTCTTTTTGTCGATTT
TGATATACCACGATATAGCTGATAAGGCGATTTAGTTAAATGCTTTTTAACTATTTTATTCAACTGCCGATGAAGAGCTTCATTCTTTTTGGCTTCC
ATACACTGCCAAAGAACTGACTGTTCAAAGTCAGTAAATTTTTCACAGATTTATCCCCATAGATGTCTCTCATTAATTTAAGCGC
ATAACTGTTCAACATCTGCGAGATTAATAATCATGATAGCCTCCATATACTTCAGAAGCTATCATATCATTGTTAGGAAGGAAAGTAAACAACTTTT
TGAATTATTTTGCCCAGGGAGCCCAAGGCGGAGGGTCAAGATGGTATGAAGCTAGTTCTTCTAGAAGAGCATCTGGGGCTTCAATTCCATAATTCTG
TAATACTATACGGTACTCTTTCTTATAATCACTAGAATCATTCTGGATATTCGTAGAATGATTATCTTCTAACATCTCAAATAAATCCATATTAATT
CCTAGCGATAAAAACCAAAATAACGATTAGCTTCAATAATCTTTCTTTCTTCTTCAGATATTCTCCAGCGTAGTCCAACATCAAAATGAGCCCAGAC
CATCTTAACAAATGCATTTATATCTTTAATATCTTCAATAATGAATGTTTTACTTTTAGAAGGTTGACCTGCTAAATTAAGTGCTAATTTAACTTTA
TCGTCTTCAAACAGGGCAAAAAGACCATATTCATGAGCTCTTTTATAGCCTTTAATAGTTAAAGCTTCAGAAGAAGAAAACGGTGAATCAGTATTCT
GTAAAATATCTTCAGTATGCTTTATAATTAGAATAACATTTTCTGGATATTTTCTTTCTTTTATATCTTTAATTAAAAGATCCGGATTTTCTGCTAA
AGGAATAATTAATGAGCATTTTTTATCAAGTGCATTTACTGATTTACCTTCTTTAGACATAAATTCTATTGAATAATGTTTTGCTACTTCAATCATG
CGATTTCCTCTTGCCTACTAATGGACCGTCAGGAATTTTGTTTTCCTGGATATATTTCTCATTTTCTTCCATCATTTTACTGCCAATTTTAAGAAGC
AAATCCATTGCTTCATTTGCTTTAGCTTTAGCCTCTTCTAATATCATATCTCTGTTCACGATTTATCCCATAGATGTCTCTCATTAATTTAAGCGC
TGAGCGTTCTAATTTCTTTTCTTTCTCAACACTAATCATTGATTTCATCCATTCTTCCCGATTCGTTCTGCATTTCTTTATTTGCTTGTTCAACCCAA
CCATCATCAATATACATCGAGTTTGGTCTATTGAACCATTCAAGCATCTTCTTCAGAGCTTTCATTTGTTTTACCTAAAACAATAGTAGGAGCATCA
TCAAATTCATGAATTTTTAGCAAATTTGGATGTAAACTATTCCATACAGAAGAAATAAAGTATGATAACGCATCTTCACTTGCAATTATAAATTTAT
TTCCTTTATCTATTTTCCAACTATATAGTGAATCGTACGAATAAAAAGATAAAGGCTTATCATTATATTGTTCTGCGCTAACATTAATGTATTCGGA
TTTAGTAAATGCTTCAATTGCTCTAAATGGAATATTTGGTACAGTTTCAATAATACCAATTCTTTTAAGTTTTATTTCAGCATCTTCTGGAACTGAC
ATTGAAACGAAATTTTCTACGAGATACATTGGGTCACAATAACTCTTATCAATCATTACTGCTACGGTAATTGGAACGTCTTTAGCAACGACATAC
TAATACTATTGATAGACATTTCAAACAAAATCGCTTCCATAATTTTCCTCAATCACAAGATGTAGATGAACAACTAGAATCACAAGAACTTTCACAT
GAATCGCCCGTCCATACATGAACAGGAACATTAGTATCATATGAATCAGAACTAGACTGTGTATTCTGTGCATTAGATGATGTAGTAGGTACTGACC
AGCGCCAAGGATTTTTATAATATTCTTGGGCTTCTTCATAAGTCATAGTAACTGCTTCTACTGTTCCATCTCCCATATAAACATACTCAACTACAGT
TAAAGGAAGGTAGTCATTTGAAATAGGAACTACACCTTCTCCGGGAGTTGTAGAGAAAAAATCCGTATAAATCGACATTTTAAACCAATTAAAGATAAAC
ATTACAAAAAGCCTCTTTTGAATTCAACTTGCTTCTCGCCATAATCATATCGAATCTCTGCATTAAATTCAACAGAACCATCTGCGTACATCATAAA
TGAATGCACAACAACTTCTGTAGACCATGGCTGTAGTTCATATTTCTTCATTACATGCCGTGAAATGATAATATCTAAATCTTCATTTGGTTTAATC
CAGCGATTTAACATAGTGCTCTCCTCTATAAGATAATTCTATTATACCCATACTCATTTTGGAAAGTAAACCGGTAAAATGAAAAAAGGACTCCCGAA
GGAGTCCTTGAATTATTAACCACCTATTTCTGTAGGCGTAAACATTGCAGCATTCTTAGTTTTCCAAGTTGTTGCATCGGAACTACATCAGAATAA
GCTGCTTTTTCTGACGGAAAGATTTGATAATGAGAATCTGCAATACGGTGTTCATTTGAATATACATCAAATGCTACAGAAACTTCCATACCCTTTAA
CTTCTTTGCCTTCACCTGCTGGATGAGTAAAGGTCTTGATGTTAACGAAACCACCCATAATAAACTCCTTTATTGTTTAATTACAGGTGTATTTATA
```

Figure 12(I)

```
TCAGTCTTCAATGAAAACTTGTGCCAGGAATTCGTGTTCATCTTGAATTTGTTTATATAAAGCCATTACAGCATTTATATTAGAGCTATCTACTTTA
AGTTGATAGGCATACCACTCGTATAAATTAATTAAAGCTTTTTGTCGTCTAATAAATTCTTCTTTGGATATTTTCATTTTGAATGCTCTATAATTAA
TTTTAAGGCTTCTTTACTGACAAAAATTTCATCAAGACCTTCTTCTACACCCCAATCAACTACACGAAGCTGATTAGATAAGAGCTCGTATGTGAGC
TCCTTGTCATAATTTTTAAATAGCTGGTCAATACGTTTCTTGTGGGCTTTCTTAAGCTGGCGTTTATTTAAACGAGCCATTAATAACCTCGGTCTTG
ACGAGCGAAGTTTTCAGCATTTTTCAGATAATAAAGTTTAAAGATTTCTTCAGCCGTAAGACCGAGGCCTTGGAACATGTTCAGAACGAAATGAAGA
ATATCAATCATTTCGAATTTAATTTTCCAACTGGTCTTGTGGAGACAAATCAGTAATCAGAGTTTCACGTCGTTCACCATGTTGAGCTTTCCAAGGCT
TCCATACAGCAGATGCATCTTTTTCACCATTGCTCATACCACCAAGAGAAGTCAATAGTTCGCGGAATTCATCATCAATATAATCTTTCTGATTACG
CAGCCAATCAACAACTTCACCCGCAGTAGCCAAATCATCAGGATGACGGTTATATTCAGGTTTATCTTTAGCTAAACGAACCTGCAGAGATTTCTGC
ATATCAAGCATAACTTGCAACGGGTCTTTTTCATCACCGAGAATATCCCAGTATTCATTTTGAGCTTTATCAGCGCCTTCAATCAGTTGTGAACATT
CATTAAAGTATGCCATTATTTTTCCTTTCAATTCATGGGTTAGTAGATTAATTATACAATAAATATATAAAGCAATAAGGAGGACATATGGTACAAA
AATTAATGGCACTTGTTAATGCCATCAAAGGTAATAAAAAGCGTATAGCTTTTACTATTTCTGCTATGGTAGGAATTTTACTCTGGAACTTTATTTT
ATCACCTGTTGCAATTGCACATGGTATTAATATTCCAGTAGTTACTCTTGATACATTCGTAGATTTAGCATTCGCTTTAGTTGGGTTAATTTAAATC
TTAGCATATTTAGATAACCGCATTTTAGCCATCAACCCCTGAGCAATATTATTTTTCATATATTCCATAATTTGTTCAGTGGTTGCACCTTCCTTTC
TAATCATATCATTAACATCTTTTGATTTCCAGGGAGATTTATCCCAAAACATAACCCTTTCTCCTGCATCAACTAATTTAGTCATTCGCTTAATAGT
GTCAGGATGACGAGGTTCATTATCTAAAACCCACACACGTCTATCTTTAAATGGAACAACTTCTAGGTCTAATTGACCACCTGTAATAGCTATACCA
TTTTCAATAAAAAGCGAATCTATAGGTCCTTCTAGAACATATACATCACCATCTTTGACTCGTTCGACTCCATAGATTTTTGTTGCCTCAGGATAAG
CTTTGATGGTGATATATTTTTGAGGAGCATCTTTCTTTAATGCACGTCCTTGAAAAGACTCAGCTTTTCCGTTAGCATTATAAATTGGAATAACAAG
ACGAGGCTCAGGTGTTTCCTTTTTATATGTTCCTGGAGCTATACTATTAACTAATTTAGGCCATTCAGTTGTAAACCAAAGATATTTCCATTTATCC
TTTGGAATACAACGAGCTTTTACATATTTTATAATTGGATGGTCTTCCGCCAATTTATCTAATCTGATGCATGACGGAAGAGATTTAATTATTTTCT
TCTCAGGTTGTTTAGGAAGTTCTTTAGGTTTTTCTACTGGACGACTTTTACCTTTTTCTTTTCTTATTTCAAAGATATACTCACGATATAAATCAGG
TTCAAACTCCTTTAAATATATTCCGATTGGTGCATGATAGTTACAGTTATAACAATGAATATTTCCTTCATTATTATCGCCATAATACCATCCACGG
GCTTTATTTTGATCGGTTTTTGAATCTCCACAAACGGGACATCTAAACCGTAATTTAAAAGTTGAACTATTATTTACTTGTGCGAATTTAGGTAAAT
GAGCCAATGCACGGTATGCAAACTCATTATCAATCCAAGGTATTGATGACATTTTTACTCTTCTTTTTCTTTAGATTCCTCTTTCTTCTTTTTAGGA
ATCTGTTCAGGACCTTTATTTACTACAGCGCCTGACGTTGTTCCAGTAGGACATATTTCAGGATTACCACCTGAATCTCCAGCTACCATATCTTCTT
TAATAAAATTCTTTATATGTTTTCATATTAACCTCTATTCATAAAAGCATTAAAAATTTGGTCATCAATAGATGGCACAGTAATATTTTCTGCATCAT
TTAGCAAATCATTAATTTCATCAGATAGCATAACACATGTGCCTTTATTTCCTGTAATTGTTACTGCACAATTACGAACGTTTTCTTTATCAAATTT
TAGGTTAATATTTTCGTAGTGAAAATCCTTTAATGCCGAATATATCTTTAAAATGAAATTGTCTTTTACTACAATAAACCCAACCTCACTATTAAAA
CGTGGTTCATGGAAACTGTAATAAACCTTTTCATCTATAAAATCGTATGAAATTTTTTCCATTTTTAAATATGAAAATTCAGAACTATACATATTAA
CCTTTATTCATAAAAGCATTAAAAATTTGATCGTCAATAGAAACATTTACTTTAGACTGTTTTTCTGATGGTAATTCATATCCACATATTACAATTT
TGTGATCAATATCAAAATACACAGAAGCAATATGATTAATGATGTTTTCAGTAAAGTCTAAATCAACATCAATATCTTTTTGACCACAGCCCAAAGG
ATAAATAATGCGAGTAATTCGATTATCTTTAACAAATATTCCACCGACATACTCTGTGCTGCGTTTAAAGTTTACACGTTTCCTAAATGAAAAATAT
TCAGGTTCTTTATGAGCCCGACTCATAGGACACAATGAGTAGCTAGAATAAGAGATGTCAAATCCTACACCTTCAATATGAGCCAACGCGTCATGAT
TAAACCAATTATAATCATATGCCAAATCCATTATATTGTAATATGTGAAAGGCACCGGATTAACATCATGTGTTGTACCTTTAAAATCTGCCCAGGC
AACGATTTCGTTATCTTTAACAATTACAAAAATTGTGTCAATAAGATATCCACGGTTATTTTCATCAGGCGTTATATTTATAACATTGCGCATCAGGA
AATTTACCGTATTTAAACGGTGGATTTTTGTGCATATAATAAATCATATTATTCACCTGTGATTTCGGTTACGATATTTTTGTTATTAAAGTTTTTA
TCGCAATACAGAACATAATTATACTGCATTACACCACCAGACTTAAGTTGTTTTTGCCACTTTAGCTTTCATTTCGGGACGATCGCGCTCAACAATAT
TCATAATATCCGCTTCAATTTGAGTTTCAACTTCAGTCTGATCTGCAGTCATAGACCATTCACACAAGTCTTTATCATATCCTGCCATAGCAGGCTG
AGCAGCACAAGAAGCCAAAGTAAAAATTGTAGCAAAAATAAATTTTTTCATGATAATCTCCTCAGTAGTTTATGTTTATATAGTATCTCAATTTCCA
ACAAAAGTAAACAGCTATTTTAAAACTTCTGCATAATCACATGTTACAAACTGTTTCTCTAGCTTAACGATTTTACGAAAATACCTTTTATACTGAC
GAATCTGCCTCTTCGTAGGACGTACAGCAAACTTAATAAATTCCACTCGACCAAATGGAGGACTTTCTTCTGCTGGAATATCTAACACCAATTCCCA
CGTATCCGCAATAAGTGCTTTGAATTGCGTATTTTTCCTGACGTTATACGGAGTAGGTTTAAATAAAACAATATGCATATTATCCTCGGTAATCTAC
TTCACATACTTTCTTGTCATCAATGAAAGCTTTAACTAGTGCTTTATTAACTTCAGCATATTGAGTAGTAGCCCATTGAACGTCATCTTTCATCATT
GTGGTTTCTTTAGTAAACATGCTTTCATTCTTAAACCACCCCATAAAAACTACCTTTACCAATTCCATAACAATCTCCTCATTTAACCAACAAGACT
ACTATACCATAGTCTTGTCAGCTTGTAAACTAAAATTTTAATTCATTTGCCAAAGCATCTAACTGAGCTCGAGTCGATTCGTTTCTTTGATAGCGAT
TCTGCTCAGCTTGTATCTGTTGTGAACCTGCTACCTCACTCACTTCAGTTGGAGTAGAATCTTGTTCAATTTCTACCCATTTCTGATTTCCTTTTTG
AACACCCATCAAAAACTTATTCCATTTATTCTTATCACCATATCGTGATTTGATTTGCTTAATAAGTTGTTGTTCAGCAGCTGCTAACTCCTCGGTT
TCAATGACCGCAAGCATAAAATCAGCTGTTGCTGGAAGACCGGCAGATTCTGCAATATCGCTCATGTTAACATCAGAAGAATCCCAAGCTTGTTTAC
CAACCTGTGCTGCAGTCCAAAGAACAGTTTCGGTTTCAACAGCAAGAGCACGTAATTCCTCTGCAATGGCTTTAACAGTTGTGTAACTATTTTCTGA
GTAAACTCTAATGCGGCAAGATTTACAAATACCCAGATAGTCGACAATAATGATTGTTGGAACAAAATTCTTCTTGAGCTTTAATTCGTTTAAAAGC
GATCGAAATGTATTAGCATCTGCTCCACCAGTAGGATACTGTTAACAGACCGAGAGTAGATTTCTCACGCCATTTTTCCATTTTTCCTT
TATACTCAGCGTAAGAAATATGCCATCATCAATGTCATCAAGAGAAACATCAAGCATATTAGCATCAATACGTTTAGCGCAGACTTCTTCTGCCAT
TTCCATGGAAATGTAAAGAACATTATGTCCGAGCTGTAAATAATCTGCTGCCAATGAACACAGACCTAATGACTTACCAACGTTAACGCCAGCCATT
AAAACGTTCAGCGTTCCAGTTTCAGCTCCGCCTTTAGTAATTTTGTTTAGAATTCTGAGTTTAAATGGAACCTTACGAGCTTTATTCATATAAGATA
GCCAACGTGCTTCGTAGTCATCCATCCAATCATGACCAACGTAACTATCAAATGAAATTGATAATGCTTGGCGCATGATGTCAGGAATAGCACCAAC
ATCCGGCATTTTCTTATTTCGTTTTTCCGGAGGAAGCTCAGCCATTAGTTTGAATTTCAATTATTTTAGATGTGGCGTTAAACATCGCCCTTTGCTGA
ACATATTTTTCTGTTTCTTTTACTAACCAGCTGTGGTCTTCCGGAGAATCAGCCAGTTTTGAAATAAGTGTTTTTACACCAGAATATTCTGTTTCAG
TAAATGAACTATTTTCTAATGCAACATTTAACGCATTAATAGATGGAACGCTATGATACTCGTTGACATGAGATTTAATTAATTTGAATGTATTTT
AGCTGGACCACTTTCAAAATATTCTGAATCCATATATGGCCAAACTTTTGAAAAATAAGCTTGATCAAATATAAGATGAGAAAGAATAATTTCTACC
ACACTTACTCCTTAAAAGAATTTAAACTTTTTCTTTGACCTTTTATTAAATGCATCTTGTAGTTGCATTGTAATACATTTTTCTACATGAGGAGCTA
ACTCAGCTTTTCTTTCTTGGTCAAGAACAGCAAAGTCCATTACAACCCTTTCCATCAACCCAATCCAGTTTAGTTACATACACTATATGTGTAGAACC
ATCTTCTAGTTTAATGACAATCTCCTGGATACATTTTCCATAGCGGATTTAATTATCTTAAGAGATTCATTAAAAAGACGTTCTTTTCTTTCTTCT
TCCCCCTCCGAAGAGGGGGATTCATCGATAATTTCTAGATCTAAATCTAAATCATCTTTATTCATTAAATTCTTCCATATCACTTAACTGCTCGAGG
TCAGTTTCTAAATCAGCAGCTGATTTACTTTTACTTTCTGGAGATTTAAATTTTTCAACCTTTGAGTTAATCAATTCATCGACTTCAGCTTCAACAA
TTTCATTACTATCAATAGCACCTAACTGATAAGCACGTTTAATAGCATCTCGGAATGGTTGATGCTTAAATAAAGGACCCCAGAATGTAGTCAGTT
GGTATCTTTTGCACGCCAAGATTTTTCTTCGCGAATCATCTCACCGGTTTCTTCGTCAAGAAATTCACGAGCATACCAGCCATTTTTAGGTTTTACC
ACAAATCCTAATTCAAGAGCCATATCTAACAATCCAGAATAAGGATCGATGCCACCGTCAAATTTAACATCAATAAAGAATTTACTTTTTTCTTTAA
```

Figure 12(J)

```
CGGTACGAGATTTTTCTACATTTAGAACAAATTGATACCCCTGAAGATCAGAACCATCTTTAATCTGGCGCTTACCGATAATGAATACAGTATCAGC
CGAATACATTACGCCTGTACCACCTGTCATCACGGTTTTACTAAACATTTCAATTGTTTCAATTGTATGGTTAACCGCAACACATGGAATATTTTA
ATGCTAAAGTAAGGAGTAACAATACGGAATAATGACTTCAGTGATTTAGCACGAGTCATATCTGCCACAGATTTTTCATTCAAGGCATCTTCCGTTT
CTTTCTTAGAAGCCATATTACCGATTGAGTCGATGAATACAATAACCTTTTCACCACGCTCAATAGCTTCAAGCTGGTTCACCATATCAATTTTCAG
TTGTTCAACTGACTGAATTGGCGTATGAATTACACGTTCCGGGTCAACTCCCATGGATCGCAAATAAGCTGGAGTAATACCAAATTCGCTATCATAG
AATAGACAAACCGCGTCAGGATATTTGTTCAAATATGCCGCAACCATAGTCAAAGACATATTTGATTTAAAGTGTTTAGAAGGCCCTGCGAAAATAG
TTAAACCAGACTGCATACCGCCATCAATTGCACCAGAAATAGCAATATTAAGCATTGGGATTTTTGTACGGATTACATCCTTTTCATTAAAGAATTT
AGATGTAGTCAGTTCAGCAGTCATTTTAGAAGTGGAAGCTTTAATCAAACGGGATTTTAAATCTGCAATAGACATTCATTTTTTCCATAGGCATCAT
TATATTTTCCTCACTGGTTAAAGATAGAGTAATTATAACACAATAAATTTAGGCATTAATCAACTGCTATTGGATGAATAGCATTAAACTTATGAAA
TGCTTCTGATTTTTCTTTGCGCGAAACACACATGCGAAGAACCTTTAATGGCTCGTCTTCTTCACCCAACGATTTTCGTTTTTCAATATTAGAAGTT
TTCCAACGAGCTTGCTCTGGAAACTCTCTATTGATTTGCTCAAGAGCTCTATTATGTTTTGAATTACTACGAATTGAACTGCACCCGCCCGGAGCCT
GTGCTTTTCCAGATACAACCAGATATTTGAACAAGGCCAAATGCGGATAACCTTGATTAATTAAATTGAGAAATGCATACATATCTTCGCATAAATC
AATTTTTCCATACCCAATTTGTTCTGTTGTAAGTTTTCCAAGGTCATACCAAGTATTCGTGAATCCATATGAATTTTCACGATAATTACCCCAAGAT
GAAGTAATTTTAAAAATAGGTAGACGAGCATGGCCATGATAATAACCGCAATCCATGGCATCTTTAACGTATTGAATCAATTCATAGAACTGTTCAC
GAGTTAATTGATTAATTTTATCTACACAGCGACGATCATCTTTCTTTCGCATTGAACTCATACGAATAGTAGTATCATCATCAATCATCCAAATTCG
TTGACCTGCATACATATCAGTAATTGCTTTACGAGTACCAGCAATTCCGTTAACATCATCAGGAATAGTTATAATTTTAGCTCTAGACCCGTAAGCG
TCATAATAAGCTTTTCTTCGTGTTCACGTACTACAATATGCCGGTTCATAATCAGATGGAAACATATCAAGGGCAGAAACTGCCCCTACGCGTTGAT
AGCTTGGAATTACGAATTGAATCATTTCCACTCACCGTTATAATCTTTTTCGCAATATGTGTTTCACCAGTTTTCCACCAATGGTCAACCAAATAA
AAATGACGGGAATACACATGAAGGCTCCCGACATTCCATATAATGGAACCTGCTTTATACTGACGAGTTGAATCACCTGCATTCAAATCAGATACTA
ATTTATCTAATACGTATTTTTGCCATGCATAATCATTACGGAATCCGAAGACCACGTCATTTGAACGCATGCTTACTACTGCATTGACTTTCTTATC
ACGAATCAGGTACTGTACTGTATTCGTACACATGAAATCTGACATACCATCTTTATTGTAGTCAAATTGCATGGATGGACGAGTATAAATCATGATA
CCACGTCGAGAATCAGGATTTTGACCAAGTTCAGCTAAACACATATCATACTGGGCATAGTTATCTTCTGACCAGATAGCCCAACCATAATTCGAGT
TAATTTCGCCTTTAGAAGATGCTACCTGCTGCCAAATCTTTGGTGTTTCACCTGGAATATCTTTAACAAACAAGCTCTTAGATTTATACCATTCAAG
TTCACGCTGAATGTATTCATCATTAAGAGCGCCAAAAATAAACGGTTCATCTGCTACAAATGATGCGCCAATAATTTCAATAGTTTTAACACCAGTT
TTATCAACTACGAAATCTTTTTCTTTTAATGCAAGCCCCAAATGAAGACGGATTTCTTCAACTGTCATAGAGTCACTAATCATTTTAAACCTCAATTG
ATACATTCATATTTAACTTGTAACAGTAATAAACCCAACCTAAAATAATAGTTGGAATCATAAGAGGAACCGTTACACTATAGTATATACTTATTA
TAATCATCAAGATTAAAAGCAACACTGCTATAATTTTGCTTTTCATTCCTTCTCTCTGATGATAATTACCTGATTTGGTTGTGCAGACTTTTTAGTT
TCACCCGCAATTGACCAAATAAATGTAATAAACCAACCAATAATTGACCAGTTAAACAGTAAAGACGTGAAAAAGATTCCTACTGTTGATTTTGACC
CACGCATCAAGGCGATGAACCATGGAAGCATGTATATAATAATAGCCAACACACCTGAAACTAAAACCATAAAAATTGAACCTGCTACTAAAGTTTC
CATGTTTTCCTCACTTAGTCAAATTTTTTACACATGAATTATAAGAATTCCATCCATCGGAGCATTTTTACCAGTACGCCATTGGTAATT
ATTAGCCCAATTAGCCCAAATTTCGGCGCAGTAGTTTTCAATTTTTTCTTCGCGTGTAATTACATCAGAATTACGATATGCTTGAGCAGATTCATCT
GGACGAATAGCTTCGTCAAAATTTGCCTGCATTTGTTCTACTGTTTGCTTTGGAGCTTCTTTATAACACTTGACATTAGGATTATAAAACTTGCTTG
AACAGTTTACAATTTTTCCTACATCAGACTGATTTACTACCGGTCCTTGAGCTACACAACCAGTAAGACCTAATGCAATAACCAAAATAGCGATTTT
CATAATAATTTCCTCAAATGCAAGTAGTAATTACTCCAGTAGTGCTTATGCAGGTATTACCCATTTGCACACCTAAAGATCCATTTGTATTCACATG
AAGATTATCATCAATTTTAACTGATATTTTTACCATTAGTGTGAATAACGGTGCTAGATTTAATCACAGGTTGAGTATCATTTTCAACACTAACAAT
GGAACTGCTACTAATGCAACTAAACAAACTGCTAAGCATCCCATAACAATTTTCATTTTATTCTCCAAATCTGTATCAGTAGTTGATAGTTGTATAG
TACCACAGAGGAACAGTCTTGTAAACAGTTTTGTGAAAATTTTTTAGGGAATTCTAAAGGTCCAAAATCATCTGTTTTTCATAAGTATAGATTTATA
TTACTTGTATGAAAAAGGGACCCGGAGGTCCCTAGATTTATTCTATCAGCCAAACAGGAAGTCTAACGAAGCTTTTCTTCATAGTCCATACCAGCC
GATTCACACATGCCCGCAAGCGGTTTAACAAACGATTTTTGGAACAAAGTTGAGTAGTCAATCCAAGACAGTACGTCAGAACGAATTTCTTTTGGAA
GTTCTGTACCCGACGGCCAAGCAATGCATTTGTCACCAAATGCATTTCCTTCACGCAATGGAAGAACCATTACTTTATTTCCATCCAAAATTGGAGC
TACACCTAAACCGCTAACAGCTCGACGATAAGTTAGCACACCACGAATATGCAACGGGCATTTAAATCCTGGCCAACCTTTATCATCATATTTCGCT
ATATCGTTCGCAGTTTTTACTTCAGCAATAACTTTATAGTCAAGTTGACGATATTCTTTCTCGAAGTTCTTGTAATATTCTTGGACAGACTCTTCAC
CTTCTTGAAGAATACGACGAATACTTTCTTCGAGAGCTTCTTGTACTGCTTTTGGTGTTGAACTCTGCTGAGTTTCCATACCCATGATTTTTAGATG
TGGTTCAGCAAATCGCTTATCTTCCATATCATAAACGTTCAGAGCATAACGTTTTTTCGCTTTCCAAAATCCACCAACACCCTTTGAACCAAGCGGA
GGACAAGAAATAGCTTCACGGTCCATATGCATCAGATGCTCGCGATTATTCATATAATCACATAACTCACGATATGCAACATCAATCATAGGTTCCA
TCTTTTTCTTACCGAACTCGATTCATGAATTCAACTAAATCATTTTGTTCTTTAAAGCGGTCAAGACCTACTTTTTCAATAACTTTATCTACACAAAC
ATATACCGATCAGTATCACCTGCTGCGATGAAATCTTCACCATTAGTTCCACATACTTTATTNAGATATTCATTAATTTTACGAGCAATCCACTGA
ATACCAACTTGGCCGAAAATTGTGATAGCAGTAGCATTTCGCAAATCATAGTAACGAAAATGAATATTACCAAGAGCACCGTAAAGACTGTTAATAA
GAATTTTACGGTTCAGCTGATTTGTGTTAGCAAGTGTAGCTGCTTTTTCACATTCTTCAATCAAACTATTGAGAACAGATTCGGTGTAATTCGATAG
TTCATTTAAGAAATCATCACTGAACTTAACATATCGTTCAACTTCAGGTTTAGTTGAACAAGACCCTGCGCCTTTCATAATAATCTTTTTAATAGCT
TCGGGCATTCATTTCTTCAGCGAACATTTTCTTTTTCCAATCTTTACGCTGGAAAAATACTTTAGCGATTTCCTTTGGAATGATACCTTCTTGATGCT
TATCATACATCCATCCATTCGGAGAACAAGAATATTCATCACTCGGTTTAGGAGCTGTTCCTGCAATATATTCATGAATTGGATGAACTTTAAACTG
CCCACGAATAGTCTCAGGACTAATGTTAACCTGACGAATAATGCTCGGATACAGAGACGTCAAGTCAAAACTCATAATATATCGACGAGCAATTGGT
TTAGGTTCAAACACAAATGCACCCGGAAAACTCTGTTTAACGTGCGAACCCTGTTGAGGAATAACCTTATGTTCACCTTTCAATGAGTTAAAAATAA
TGGCATCCCAGGTTTTAATAGGACTCATTACACCAGAAAAAGGCATTTTAGCGTAATAAGACATACTTAAAACTAGATCGATAAACCCGCGAATTTT
ATCAATTGCTTGAACTGATTCTACGTCAATGATGTTATAACTAATGTATCGTTGATGATTAGTCTCACGAAGTTTATTAATAGGACCGTCGTATGGT
AATTTACCTTTTTGGTTTCATGCTGAGCAACTGATTCCAAAGAGAATGACGGCAAATTAGTAAATGCGAATTTCTTATACAAATCTAAATAATCAA
GAATAGATACGCCATCAATAGAATAAATTTCTTTGCTACCGTACATATTTTGGATAAGTTTAGATTTTACTCGACCGATTGGAGAGAAGCGTTTCAT
ACTACGTTCACCGAGAACCATTTTAACGCGATTCATGATATACGGAACGTCAAATCCCTCAATATTCCAACCAGTAAAAATAGCAGGTCGTTTCTGT
TCCCAAAGATTAATATATTCCATGACATATCAGCTCATTATCAAATAATTACTCGGTCAAGAATTTCTTGAGGAACTTCATCACCAC
CTTCACAGTCAAGCTTAGCAGCTAACTTTGCATCCCATTTTGATACTGAACCATACATTGAATTCAAAAGGTCGAAAACATAAAAACGATCGTCAAT
TGAATCATAATGAGTGATAGCATCAATTTCATATTCTGCTTTCATTGGGTCAGGAAATTTATCACCAGTAACCTCAATGTCACAGTTAGCTACACGA
ACAAATTTTCGGTCATAAACAATTTCTGAACCATATGTATCACTGATATAAGCGAGTTTAAAATCGTTCATACCGAGAGCTTCGAGACCGATGTCTT
CCATTCTCTTCATCCAATCTCGAGCATCTTTCATTGATGGAAATTTTTGAGGAGCGCAGTTTTTACCATAGATGTCTTTGTACTTTGACTCTTCCTT
ACAATGCCTAAACATAGTTGGAAGATATTCTACTTCACGAGTACGTTCCTTTCCGTTTTCATCAATATAACGTTCAACAATGTTATTTCCGACTGTT
TCGATAGAGATATAAAATTCTTTCATAGATATTCCTTAGTTTATAGCCCGAGTTATTAGGCTCTTGATATATTATACTCCAAATAAGGGGCCGAAGC
```

Figure 12(K)

```
CCCTTGCTTAATTACCAATCGTATATTTAGGAACGAGTTTCCATTCATGTTTTTGTTTAAAAGAAATAACTCGGAAGTTATTAGTTAAATCTTTCAT
AAAAGTTCTTTGACCAGGGACGATTTCAATCAGTCCCCAATCTTCTAACAGCCATGCAATCGAATCACGACGAACTTCATCTTCTTCTGTCATTTCA
ACTTGACGGCCATCCATACGAAGCATTTCTTTAAAATGAACGATATAGTACTTCCTTTTTTCTGAAGAATATGACAGGACTGATACAGAACTTTAT
CTTTTATTATTAGCAATTCCCATACGAGTCAAAGTTTCTTTTACTTTCAGAAAATCTTCAGGTTTTTTAAGAGTAATTTCAATCATTTTACCATTCCA
ATGCTAGTTTTTGAGTTGTTTCTGTTCTTTTACGTTCTTAGTCACTTCTTTCAAAAAATCATCCGTGACTAATCCTTTAAGTTCTTTTAATACTAA
AGGTAGTTTTCCATTTTTAGTAAGAATTGATTTATAGTTAATTGCATCATTTGTATTAACTTGATACCGCTTAGCAAGTAACTTAATAATCAATACT
TCGGTGGAATCTTCAACTAGTTTTGCCCATTTACCATATCTTTTACCCCGAGGAACTGCAGCCATTAGATAATTAAAATGAGCTTCATCACTTAATC
CAGAACCGATTAAATTCATAGCATATACAGCTGGCATGCACTCTGGGAAATTTTGATAATGCATTTTCAACCATGAATTTTGAATAATCTTTTTGAGC
AATAGAGCATTTAGTTTTATTATTAATAGCTCCAATTATTTCAAAAAACTCATTTTCAGCTTTTTCTTTAAAAGAATCAGCAGCGGATTGGACAGCT
GTCCAATCTTTTGAATACCAAGCAACTTGATGCTCGTTTAATTGAATATCATCTTCAAATAAGCTCATATCACTTCCACTGCATTTCACATGCTAAC
TGAATGAAAGATAAGCTAAATGCAATTCAGTATTAGCTGCAATACCATGATACTGATTATTTTCGCCGACAATTTCGTACATACGAATAATACTCT
GTGGAGTTACACGTGAATAGATTTCTTCGGCAAGTTTACCAACAAACCAAGAATAATCGGCTGCATATTTTGGTGCTAAAGCTCTGAGTTGTTTAAC
ATCTTTATTTTTGAGAGACTCAAGAACATCATCAATAGCACCACGATCGTTAGTAACCAGTGATAAAATACCAGCATCCAAAACACCTTTAGATGAA
TAACTATCGAGCTCGCCAATAGTTTTACGAAAATCAGGAAAATTCTTTTTAACCAAAGCTGCTACAACTTTCATATCAGCTATAGCAATTCCTTCAT
GCTTGCAGATTTCAGTTAATCGACGAATCATCTGCTTCATCATTTCAATTTTATCTTCATCAGTTGGTTGACCGAATGTAATAACTCGACAGCGTGA
CTGAAGCGGTTTAATAATACCATCAATATTGTTAGCAGTAATAATAATACTACAGTTTGAGCTATAAGCTTCCATAAAGGAACGAAGATGTCGCTGA
GACTCTGCTAACCCTGAGCGGTCAAATTCATCAATAACGATTACTTTTTGACGACCATCAAATGAAGCGGCGCTGGCAAAATTAGTCAAAGGACCAC
GAACGAAATCAATTTTACAATCTGATCCATTCACAAACATCATATCAGCATTTACATCATGACACAATGCTTTTGCTACAGTTGTTTTACCTGTTCC
TGGAGAAGGAGAATGAAGAATAATATGTGGAATCTTACCTTTACTTGTAATAGATTTAAAGGTTTTTTTATCAAAGGCGGGAAGAATACATTCATCG
ATAGTAGATGGACGATATTTCTGTTCAAGAATGTGTTCTTTTTCATTTACGGTAATCATAATTTCCTCATTCAAGTTTTAGTGTAAATTTAAGGGCC
GAAGCCCTTTATTAAAATCGTGGGTAGAATCAGCTTCAAGAGCTACCACATAATTCGCGTGTTCACCTTCAAATTTAGCAGCACCTTGTTTACCTT
TTGCCCAGAGCAGAAGTTTATAATTTCCTGGTTGCATTTTCATATTTGCCATATTGATAATGAAATTAAATGTATTTTCACCATCATAATCACCAAG
AGTCAAAGAATATTTAACACGGGTCAAAGCAGAATCTTCTACTTTATTAAAACCGTTAATTACGATTTTACCTTCTTTTACCGTGATAGCAATTGTA
TCAATTTGCAGACCACGAGATACACGCAACAGTTGTTGAAGGTCTTCAGCTTTAATTTCAGTAACAACAGATGCTACCGGGAATGGAATTGGTTTAT
TAGGAGCAACTACTGTACTCGGATCGGCTGCTGGCCAAAAAATTGTTGAGCGTGCATCAGCAATTTTAATATTTCCATCTTCTGACTGGGAAATTTC
TGCATCATCATTAACTAGAGACAGAATACCGAGAAAACCGTTCAAATCGTAAATTGCTACATCAAAATCAATAACGTCAGAAATATTTGCTTCCGCA
TAAGTTGTACCATTAACTGCACGAGTCATAATAAATTGACCGGATTTAAGCATAATACCGGAGTTAATAGTAGCGAAATTTTTCAGCAGAGCAGTAG
TATCTTTAGACAGTTTCATGTAATTTCCTTCAATTCAAATGAGATTTAATTTTATAACTAATTTAATAAAGCAATTAACGATTAAAATCAGCCGCAA
TTGTTTCAGCAACAATTTGAGCAGCAACAATTAGGCGTTCATCTGCATTACCGCAATATTCATCTTCAAGGCGTTCACCACATGAAGTCATAATAAA
TTTAGCACCGGCGTTTAGGGATTCTGCAGTATGTTTGCGCATTAGTTCAATCCATTTATTACTTACTTCACGATCGATAGCTTCATAATACGCATGA
CGAGCAGGTGCAGATTTAATTTTGTTCTGAATAACTTCCATTGCGTTATCAGAAGGACAAAAACCCATGCGCGACGAATTTTATTTTGGTTTTGTG
GATTTGATTCAGAACGCACGTGTTTTGGCTGAATATCTTTTACATCAACAGTATAATTCACGGTAATTTTAGTCATAATACACCTTTAGTCATAATA
ATCAGTAACAGTCCAAGCTTCATTTCTGTTGGACATTATTTTCGTATATTCTGATTTAAATGCATTCTTAAGCATAGATTCAGTAACTATATGCTCT
TCATTAGAAAAATTATTTCTCAGAATATATCGTTTTATTTCAGGAATAGTTAATAGATGCTGTCCAGTTGAATATTCTGCCACAGTTCCTCCGTATA
AATATGTTTATCACTCGCTGTATCAAAAGGATATGTTATGAATTATAAACTAATTTATGAAAAGTTAATCTCTAATGCTAAATCTCGAAAACTTGAT
TGCTATACTGAATCTCATCACATTATACCGCGCTGTTTAAATGGAAGTGATGATGCTTCAAACTTAGTAGATTTAACACCAGAAGAGCACTATGTAG
CTCATCAACTTTTAGTAAAAATTTATCCTTCTGAACCAAAATTAGTCTATGCTGCTAACATGATGACAGTTTCTACGAAATACGCTAAACGCAACAA
TAAAACTTTCGGTTGGATTCGTCGTAAACTCTGGGAAATAGAAAAGAACAAAGAATTCTCCCAGGAGACACGAAAGAAAATGTCTGATGCAGTAGCT
AATAAAGCAAGACTAACTTGTCCTCATTGCGGTAAGTCTGGATTAAGCGGGAATATGAATCGTTGGCATTTTGATAACTGCCCAAATCACCCTAATC
CTAAAGTTAGACCACCAATCTGCTAAAGAACACAGAAATAATATCTCAAACGGGCTTAAAGCAATCGTTCTTGAAGAAACATCCTGCGAATTCTGCGG
AATGATAGGCAAGAAATGCGTTATCGCAGCGCATAGAAATTTCTGCAAGAAAAATCCAAATGGACGCAAGAAAACTGAAAAGACTGGTACTTGCGTC
CATTGCGGTAAAGTTACCACTTTCGGAAATTTATCAAGGTGGCATAATGATAACTGTAAATATAAACCTAGCTAATCTTAGCTAAACTAAATCTACC
AACTTTTTCCATCTGAATATGCTGACCATATTCTTGTGGGTCATGGTCTTTATGCGAAATTATGAAGAAGTTGGTATCCTTCAAACCATCTAAAATT
TTAGCTACATTTTTAATGCCTTCAGCATCAAATGCACCATCATACACTTCATCAAGAAATAAACAACTTATTTTAACACCTGAAACTTTTTCAGCAA
TATCACGCCAAGTAAATAAAAGAGCAATATCAATTCGTGCTTTTTCACCTTGACTAAATGAAGCATAACTAAAATCTTCACGACCACGGGATTAAT
TGTCTCATTAATTCTTCATCTAATGTAAACACATAATCCGCTTCCATTATTTTAAGATAATGGTTAATCTGCTTATTAAATAATGGAATGTACTTT
TTAATAATAGCACCTTTAATACCAGAATCTTTGAGCATATCAGTCAAAATTCCTCGGTGTATTTTTCCATTACTAAATTAGTTTTTGTCTTAACAA
TTTTATCAAGTTCTTCTTGAAGCAATGCTATTTCATCAGCATGGTCAATAAACTCAGAAGATGCTTTTTCTATAGCTGCTTTAACTTTTTTAGCTTT
ATCTACTGTCGTGATTAGAGATTGCTTTTTATTGCGAATATCATTTGCCAACGACTGCTGGGTTTAATATTATCTCGGTATTCATCAACAAGAACT
TTTAAAATTATCACGATGTGTTGAAAGCTGTTCAAACGAATGCGTACATTCAGAAACTTTATCTTTAATTTTAGAAACAACTTTATCACCGGAACTTA
ATTGTGACAAACAGGTTGGACATAATCCGCCTTCGTGATACATATTAATGCTTTATTATACGAGTCAATTTTTGATTTAATTAAAACTGCTTCTTG
ACCGATTTTATTAAATGCATCAGTCGGGTCTTCATCTAAAACAATATTAACTAATCTTTCATTAGCTTCTTCTATTTCCGATTTTAGCGTTCTAGCT
TCTTTTGCCAAATCATCATACATATTTTGAAGACGAGTAAGGTTGTCACCCGTTAATTTTTTCTGGCGTTCAACGTTATCATTATATATTTTAATTT
GTTGGATAATACTATCTTTTTTAACATCAAGCACTTGGTTCTGCCGAATTTAATTCACGTATTAGTGCTTATTAAGCTTATCCATTTCAGCTAATGT
TCCTACCTCAAGCAGGTCTTCCACAAGCTTTCTTCGTGCAGGGGTCGACAAACCCATGAAAGGGGTATACCCTGCTGTACCAAGGACAACAATCTGC
TTGAAACTGGCATATGACATTCCGATAAGCTGTTCAAATTCTGCTTGGAAATCTTTACTGCTGGCAGATTCATTAAGACGTGTACCATTAATGGTGA
TTTCGAAAACGTTTGGTTTTTGTCCTCTTTTGATATAGTACTTTTTTCTCATCATATTCCATCCACAGTTCAACTAAAAGTTCTTTCTTATTTGTGCT
GTTTATTAATTGACCTTTCTTTACATCACGAAATGGCTTGCCAAAAAGCCCGAATGTGATGGCTTCTAACATAGTAGACTTACCACCGCCATTCGT
CCAGTAATAAGAGTTTTTTGAACCTTATCTAATTGAATGTCAATAGGATTTCCACCTACTGACATTATATTTGATATCTAACTCGGTTTAGTTTAA
AATTCTTCACAAAAGATTCCTTTTAATGTATCTTTTAGACCATTCTATCATATCATCATAATCTAAAAAGTATTCATCAAATTCAGCCATGCAAACA
ACGCCTTGTGCTGTTTTTGATGTAATATAAATTATTCCAACATATCTAGAATCTTCTTCGGTATAATCAATATTTGCTATGAATTCATCATTAATGT
CAAATGTCGAAAACTTCACAGTAGCATCCTTAATACAAGATACAGCCATTAGGTGTGTCATTATCTAAAATGTTGAAGTTAA
AAGATACAGCCCAATCAGTGCAGACCGTGACCTTTTTAATACAATTATCTTCAACCTCTAGCGGTTCAAACCAATATTCAATAATTTCTTTATGCCC
AATATCATCTTTTACTTCACATTCAAAATGCTGACTCATCATAACATTTTTAAATTCATCAAAAGTCATTGTGTTGCCCTCTACATATAGCTGATTCG
CATATTGAATAAGTGCTTCACGGTCAGAATCAGTGATGTCTGGAATTGCATTAATGTATTCTTCCATCAACGTCTGAAGAGATTGAACTTCAACTTC
TTCACTGTCATCTGACTCGACAGAGTTATCAATCTTTGACACAACTCGTAATGAATGCACAACTTTCTCTAGTTCAGATTCGAACTTCGTCAGATTT
```

Figure 12(L)

```
TTGTCTACTTCAGTTACTATAACACGTACTGATAGATTTGTAAAATCTTTATAGTCAATTTTTCCTTTAAATGGATAATGAATTCTACGATGCCAGG
TAGTATTGTTTGGAATAAATTCCATTCGTTCTGTTTCTGTATCAAACATCCAGAACCCACGAGGGTCATTCTCGTCACCGGCAGTTAGTGTCCATGG
TGTCCCAATATATCTGACATTAGCAGCCTCAGAAATAGTATGGAAGTGACCAGACCACACTTCTTTATAAGTCTTAAGGAAATCAGGTTCAAGACCG
TGAGATTTCATTCCTTTATAAAAATAAAATCCATTCAGTTCCCAGTGACCAACACAAAAAGAAGCAGAAGAAGTTTTTATGTGCTCGAGAATTTCAC
CAGTATTTTCTTCACACATCCAAGGAATCAAATCAATCAAACACCCGTCAAAATCTACTGTAGTAGGCTTATCATATACTTTAACATTAGGATATTT
AGCCAAAAGCTCAGTAGAGGCATTTGGATGCATTACATTTTTGTAGTGGAGATCGTGATTTCCTACAATAGTATGTAGGGTAATACCAGCATCATCA
AGCATTTGAACTATTTCACGAGCAAACTCCATAGTTTTATGCGTGATCGCTTTTCGCACATCAAAAATATCACCGTATTGAATCCATACCGTAATTC
CATTTTTCTTAGAATATTCTATCGCTTGCTTAATTCCATCAATTTGAATACCGCGAATCCACTCATCATCAGCTTTAACGCCTAAATGCCAATCACC
TAAATTTAAAATTTTCATATATCAAGAACCGTCATTGAAATGCAAAATAAAATTATTGAAATAAACCCATCTGGTGTGCTAAAGAAACCAATCCAGC
ATGCTCTAGTGAATAGATAAAATGCAAGAAAAAGTATCACATATCCAAGAAATATCATTATATCAAACTCCGTATAAAGCTAAAGGGCCGAAGCCCT
TTATTTTGTAATAATGTCAAACTGTTCTTAAAGCAGAAGCTTGAATCTTGATGCTGATACAAAAATTCATAAGCTTTTTCGCGTTCGCGGTCATAA
AGAGCTCGGTCAGATGACAGTTCTTTAATACGTTCAAACGTTGATTCCATATCATTTTCATCAAACCAAATGATACCGCTATCATGCGAGGTCAAAG
GAGTATTATCAACACGGAATTTTAAATTTTCGCCAGTAGATTTCCAAAATACCGGAATTGTTCCACATGCACCAAGCTCGAGATGAGTATATTCTAA
AGAACGTTGTAGATATTTTTTGTCCAACTTACTCAGCTGATAACCAAATCCGGATTTACTCATGCGTTCAAGCATTTCGCTATTTACATAACGGTCA
AGAATTTGCGTTGGCAAATTAGGAGCAATTTTAATTTGGTCTACTTGATGAAGACGATAATACTCGTATGGAATTCCTTTTTCTTTAATAGGAATGA
ACGCTGGAGAACGTTCCAGACCTTCCATAATAGTACTTAGTCCTGCAGGTTTAAGATGTTTTTCATGAAAATCAAACATCTGATAAAAACCTTTCCA
TGTAGTCGTACGACCAATCCAACGGTTGATATTCATGTTAATTTCAGAAACATCTTTCCAGTAGGTTGACCGAACCTTCGCAATATCCATAGGAGGC
TGAAAGTTATATACTGTCGGTGCTTCTTCAATATCATCAAACAGAGAAACTGTTTCAGGATACCATTCTTTCATCAGAACTTTATTAAAATCACCAT
TATCAGAATGGCTAAAAATAACATCAGCTCGACGAACAGTTTCTTCTAATCCCAAATTTCGGCGCAAAGAAAGAGAAGAATGGTCATGTTGATAAAC
TACAACACGAACAGAAGGTTTAATGTTATCAATAATTTTTTTATAGTTATTAATAGTGTCTTCTTCAACCGAAGTAGCAGGAACTGAATTGATAATT
AGAATATCACAATCATTTACCAGCTTAAGTGTTTTATCATATTCTTTTGCCAATAAAACCGGAATTGAAAATGATTTATAATCATGCGCGCAATTAC
GAGTAAATGATTTATCTTTAGCATAAACCAAAGTTACTTCATGACCATTCTTAATAAACCAATCACGTTGCTCAAGAGAAAATTTAGTTACACCACA
ACCTTCAAGACCTCGAGCCATAAAAATACATACTTTCATTTAATATCCTCTTTGTTTTGGTTTATTTTACCAAAAATTTATAAAGCAATATAGGAGC
CGAAGCTCCTATCCACATAATACGCCATACAGAGGCTCGTTAGAACTTTTAAATTTTATGCGCTTATATTTTATAGTTCCTTCTGCTTTAGCTTTAT
CATGAGACTCTTTAAAGCGTCTCATCATTTCCTCTTTAGAGGAACGAATTTTATTATAATCTATTTCAGAAGTCTGGGTGTTCATCTTTCACAGTTG
CCACCATTTTTTGACTTGATAGGAATCAACCCACACTTTCATATTAGGGTCTGCTCTTACAATAGGAGGATTAACTTCTTTAATTGAACTATCATGG
TATTCTTTTTCAGAAATTTTCACGCAAAGATGACCATTCAAAGATTCAGTAAATCCTGCATTAATTTTAAGACGCTTGAATTTTACGTGTGTAAGCA
TCAATCATATCCTCAATCTGCGATCTAGTAGTCTTCCAAAGAATACTGATGAGTTCATCGTTATATGGCTGTTTTAGAATATCCCGACTTTTCTTGA
TAGCATATTCGTATTGAGCAAAATTATTGTTTTCAGCTGCAGTCTGAGCGTGCTTATAAAGACGATTCAGTTCGCGTTTGTTTTTAGACAATAACTT
ATTTGCTTTTCTTTCTGCTTCAAGACGGTTCTTTTCTTCAATAGAAGAAAATAAGCTTTTCCACTTCATCATTAATTTCGGGTTTATCAGTCATATTA
TTTCTCTAATATAAAATAAAAATCATCATCTGTTAAATGATACCGATAGTTTAATTCTACACCATTAGATTTAAAAGCGGTATCATACGGATTTTCT
GGATCAATATCAATGTCAAGAGCTAAAACTTCCCTGAGATACATTTTAAGTAAATAGGGAATAGCTTCAACTTCAGGTATTTCTTCCAAGAATCCGG
AGAGGTTAATCGTTAGCCTCATATAAAAAATCCAAACTAGGAGAATCGTCTACAACACTTTTCTTTTCAGCCCCCGGTGTTCTATAGGTTGATTCTT
CGTAATGCGTCATTTTATCGTAGATGTCTTGAATAAAAGTTTCATCTACTAACGCAACCATATCGTCGTCACGGCTGTCATAGACATTGTGAACGAA
ATAACTATATTCTTTGCAACTTCCTTACGTTCTTTTTTAATACGTTGGACGAATGCATTAAAACAAGCTTGAGTTATATATGCATGTGGGTTTTA
TATTTCGTTTCATCAAAATTATGAAGCCCCTTAATAGAAGCTTCTATACCATCTGCAATCATTTCTTGTTTCCAAGACTGGGTGTATCCTGAAAAGT
TGAAACGTTTAGATAAGCCTTCTGCAATAAGCATAATGGCTAATCCGATAGTATCATTCTGACGAACTACTTTATTTGGGTCTTTATTATTTGCTAA
TTCTGTTTTCCAATCAATAATAGCTTGTAAAAGCTCTTTATTGTTACGTAATTATATTTAGGCTTAGTTTCTGACATTTTCACCTCTTAGCTCAAT
TCATAGATCTATTATATCATAATATTTGAAGATCTATCTTAAAGCATAGAGGATATCAGTTATCTAAGTAAACAATATGCTTGGAATACTTTCTCCA
TCATCTTTTAAATTCATGAATATCTATATAATGACTAGTTAAATCAGCATGATATAAAAAGTCTAAAAACTTTTCATGTGTGCTAACGTATTCACT
TTCATTTAATTCAGAAACATGACTTTCCCAATATCCAACACCAGTCTTATTTGGGAAAAATGAAATTTTCATGTATTGGTCAACATAGAAAATGCCA
TAATTTTCAATAGTAATAGAAATATTAATAAATTTCATACATTCATCAACTTAGCGCCTTCAAGAGCTGCATCTAGTGAATCAAATTGATCAACATA
TTCAATCAATTCGCCGTAATTGGCATATAACCACCATTGGCTAAATTCATACTCAAGGATGAATCCGTTTCCTTCAATTTGAGTTAAACCAATGCCA
TTTGTATTTACTTCATACCCAGCAAGACGTAAATCGTTAATAAGAGCTTCGTTCATAATTATACCTTAGTAATTTTCAGGTCTGCAAATTTTTCTT
GCGTTGATTTTTCATACGACGAATAGTTTTATCGGAAATTTCATGCTTTTGATAAGCTTTAGATTCTACACCAAAAGCTTTAACATCAAATTCTGAC
AAGATATATTGAACCAACAATTCACGGACAGTATTGCGTCCAATCTTCTGATCATTCTGTTTCATCGTCTGATGAAGCTCTTTTTCCCATTTATCCA
AAATTTGAGGAGTTACAATATCGCCTTTTTCTAGCAGAGAAACTACTTTATCATATGCGTAAGAATTGATGGCGTTTTTAATTTGAATAGTCATACA
TTATCCTCAATTGCATTAAAATTTTATTATCCAAAAAGGGCCGAAGCCCTTAGCTAAACTTTTTGGCGCCCTTCCAGCCTTCGTACATCATTGCGAC
TGACAATGACAAGGCTCCTTCGCATGCTGCATACTTATTATTCCAGAACCAATTTAGAAAAACTTCGTCCTCAATACCATTGTGTTTCATGTTCTGG
AAAAAATTTGGCGCGTTCTTCACGAAGCTTTTGCGATAACATAGATTCAGGATTCATTTAAATTTTCCAATTACCGTTTTCATCAATGAATTTAATCC
AGTCATTTACTGACCACTTAGTTGTATCGCCTTTTGGAGTAGCATTTAAAGTATATAGCCCTTGCTTAAAAAGCATTCGTTTGATATTCATATTTTC
CTCAGCTGTAACGATAACACTCGTTTGATTTGCGTTTAGCAACTCGTTGAGAAGTATTATAATCAAAATCATCGTCAATGTAAACTGATTTTTTCAA
CTTTCTTACTTCACCACGTAATTGACGATTCAATTCATTCTTAACCTCTGAATCAACACCTCGCATACGTCGCCATTTATCTGAGCGAAAATGTTT
TCAACCATATCTTTATGACTTACACCATCAGGAGCTTTACGCTTTCCGAAATAGTCATAATCACGCACTTTTAAGTCTTTACGACGATCGTTTTAC
CCATGGAGTTTAATTTCCTTAGCAACTGAACTAAATGCAGCACGATCGCAAATCATGCGTTTATGTAACTTGAGTATAATATAGCAAACTTCAAAAC
TATTTACATGAGTAACACGAACAGCATTACCATTAATGAGATAATACTGTCCCTTTTTAATTTCTTTATCAACCATAACCATATCAATTCCTCAAAG
GTAATTCATATGTTAATAATACCACAGTTTGAGCTCGTTGTAAACAACTTTGTGAAAATTATTTTAGGGAATGATAAGAAGGGAACGATAGCTTAGA
ATGGTAATATACAGAATGTAAGAAAGAAAGGCCCGAGGGCCCGCCTTAGTCTTCTATGATATCTCTATCATATCCAAGTGAAATGAGAGTTTCTTT
GAAGTGTTTAATGTTCTTTTGTCTAGAATCATTGATGAAAATGACTGGATAACGAATGTTAAGACATGTGAATCCAGCGCGTTAGCAAGAGATACA
ATCAGTGGACGATCATACTCAATCTTACCATTATTTGTAAGAACTTTATAGAAAGTAAAAGGAGCATTAAGCTCCTTTAGAAGTTTTGTAACTGATT
GACATCCAGGACAACGACCTACTTCATCTGGAATTCCATAGACTTCAATCTTATTCTTTAAGTTCAGTTTTGTTCCACGAGAAATAATTCCTTGAT
AAGCCCAGTATGGCGGGTTAACAGAATCATCGCCAGAATTTCTTCAGGAAAATAAACCTGGATAACAAATCCAGATGCATCAAAGGTAAAATAAAC
CGTAGGTAATTCACCTAACAATTCAGCGCGGTTATTAATTTCTTCAAGTTCTCGTTCTCGTCCAGCCCAAAAACTAGGATTTAGACTACATTCATAG
AAATAATAGTCATTACCGAACATATCAAAACCCTTCCAACTCTCTACCACATATCGCTCAAAACTAATCATAATTAGGCCTTTTATCAAGAACAGC
ATTCAGTTTGTTAGTAATTTTATCCAGACGCTCATTGAACTCGCTAGAAGATAAGCCTTTTTCTGGAGAAATTAAGCTAATCACGAAAAATATAGCA
ATAAAAGGAATAAGAAAAAATAGCACCAACTGCCATAAACAAAAAGAACGTTACAGTTGTAAGAAAATCAGCTAAACCCTTTACGAAATTTATACATAT
```

Figure 12(M)

```
TTTACCCTTAATTGATTAACCAAGCATTGATAAGCACTAAACTATATTGCGAATAAAATTCTGGACCAAAATGAAAAATCATATCATTTATAGTATC
CATAATGTAATTCAATTTAATCATGTTTCCACACCCCATCGGTATTTGACCAAAGTCGCTGATTATCTGATCCTCGCCACAGCTTTTTGGTCGGAAG
ATTTTTCTCATACTTCCCATCAATAATAACATCAACATATTTAAGCATTTCTAGTTGTTTAATATCTTCAAACTTATATCCTGTCCACAACCAAATG
CTTTTATTGGGATAAAGATTTTTAATAGTTTGAACCACAGAGTGAATCACGTCTCTGTTATCAGGATAGAGAGGGTCACCTCCGGTTATAGTCAATC
CTTCTATATAATCATTATTCAAACATTCAATTAATTGTTCTAGTGTTTCACCAGTGAATGGAACACCATTTCTAGCATTCCATGTTGATTTATTATA
ACACCCTTCACATTTATGCAAACAACCTGTAACGAAAAGAACGGTCCTGCAGCCAGGACCATTAACAAAATCGCAAGGATAAAATCTATCATAATTC
ATTGGTGCTTAACCCTATGCATGATTTCTTTATTTTTGCCGAGATTAAATCCGCGTTCGTTCGGATTTCCCAAATAGCCACATGTTCTTCTTATTGT
GTTCATCTTTTTAGGATCAGTTTCTCCACAAATAGAACAAACAAATCCGTTTTCAGTAGGAGTCATTTCATGGGTACTTCCACATGTAAAACATTTA
TCTACTGGCATATTAACACCAAAATAATCTAAATGTTGTGCAGCATAATCCCAGACAGCCTCAAGACCTTTTAGGTTATTTTTCATATCAGGAAGTT
CAACATAAGAAATGTGACCACCTGTCGCAATGAAATGATATGGGGCTTCGCGAGAAATCTTTTCAAACGGAGTAATATTTTCTTCTACTGAAACATG
GAAACTGTTAGTGTACCATCCTTTATCGGTAACATCTTTTACACTTCCATATTTTTCTGTATCAAGTTTACAGAAGCGATAACAAAGGTTTTCAGCA
GGAGTCGAATACAAACTAAAAGCAAATCCGGTTCTTTCAGTCCACTGCTTAAGATGAGCATTCATTTTAGTTAAAATTTCTTGTCCAATATCACGAC
CGACAAGAATATTCAATTCATGAATACCAATGTATCCTAAAGACACTGAACTTCTACCGTTTTTAAATAACTCAATTATGTCGTCATCAGGTTTAAG
ACGAACCCCGAATGCACCTTCTTGGTAAAGAATAGGAGCAACAGTCGCTTTAACTCCTTTTAAGGAACTAATTCTACACATCAAAGCTTCAAAACAT
AAATCCATTCGCTCATTGAACAATTCAGTAAATTTCTGTTCATTGAACTGTGTTCCAATATAAGAATCCAACGCAATACGAGGAAGATTCAGTGTTA
CAACACCAAGATTATTACGTCCATCAAGAATTTCATTACCGGTTGAATCTTTCCACGCACTCAAGAAACTGCGGCAACCCATTGGAGAAACAGGAAT
AGATGAGCCGGTGATAGCTTTATTGTTCTTAGCTGAAATAATATCAGGATACATCCTTTTGCTTGCACACTCTAGAGCAAGCTGCTTAATATCATAG
TTCGGATCGTCTTTATAAAGATTAACACCTTCTTCAACGAACATAACAAGCTTAGGGAAAATAGGAGTTATCCCATCACGACCGAGACCTTTAATAC
GATTTTTCAGAATTGCTTTCTGAATCATTCGTTCAGTCCAGTCAGTTCCCGTACCAAATGTAATTGTTACAAAAGGAGTCTGTCCGTTTGAACTAAA
GAGAGTATTTACTTCATATTCATAAGCTTGGAATGCATCGTATACATCTTTTTCTGTTTTAGATTGAGCATAATTTAACGCATCAGCGATTTGCCAT
TTTTCTGCATCCTCAATATGTTTTGCATAGGTGCGTTTAACATAAGGAGAAAGTACTTTATCTACATTCGCAAAAGTCGTTCCGCCGTATTGGTGAG
AAGCAACTTGCGCAGTAATTTGTGCCATAATTGCAGTAGCAACTCCAATTGATTTAGGAGTTTCAATCTGTGCATTACCAAGCTTAAATCCGTTTTC
AAGCATTCCTTTTAAATCTACTAAACAACAATTAGTAAATGGAAGAGCAGGGGAATAATCAATATCATGGAAATGAATAATTCCGCTTTCATGCGCT
TTCATAATAAAAGACGGGACCATATTTTTGGCAATGTGTTTAGACACAATACCAGCCATAAGGTCCCGTTGAGTTGGAAAAACACGAGAATCTTTAT
TAGCATTCTCGTTTAAAAGGTCTTTATTAGTTTTATGAATCAATCCTTCAATTTCTTTTTCAATTGTCATTTTAAACTCTTTCTAAGCTGCTTCTTA
AATGAAGCTATTAATTGTGTTTTAGTGTCAGATTCATTATATTCAAATCCTCTTTGAAGCATCTCAGCCATCATTTCCTCTTTTCCTAAACGAGAAA
ATTCCTTTGATTTATCTCCAACAAAGTTAGGGTGAATATTATTTTGGGTGTAATCGGATTTTAAATAAGTAAGTAAATTTTCTAACCATTCAAGATA
ATCAACACCTTGCCCCTTTAAGCCAGAACGATTAAATTTATGTTTCATTTGACCTTCTGCGGCATTGCAGAGATTACAAAGCAATCCACGTACCTTT
CCTGCTTTTGGTCCATTTAATTCATGGTCATGATCAAGATGATTAGCTTGAACATCAGGATTTAGTTCTCGTTGGCAAATTAAGCATTTACCGTTTT
GTGCATCATAAAATTTCTGTTTTTCTTCTTTGTATAATTTGCCAGTCAATAACATAATAAACCCTTACCTTAAATAGATAAGGGTATTTATTATTTT
CAAGTATTGTAAAACATTCGATGCAATCGTTTATACTGTCGAATCATCTTTTTAGTAGGACGGAATAGGTTCCTACGCAAGTGGTCATATGAGGGT
CCGTAGAATGTCCTTTAATAAAAAGTTTCCAAACCTTACCGCCATTTAACTTTTCAGTATAAACCAATTCGGTTTTCATTAAAATGTCCTGTCAGAA
AAAGAATTTTGAGTTTTTTCAAGTATTGTAAAACATTTGATGCAATCGCTTATATTGCCGAATCTTTTGGTCAGAAAAAGAAATTTGAGTTTCAAGC
CATTCAATGTACTCTGCGGCAGCTTGCATCAGGTTACCTTCATAGCCATCGTTATTTTCTTGCGCAGCTAATTTAGCTAATGCGTATGAAATACGTT
CACCTTGAAAAGCGGCTTTAGGCTTCTGAACATCTTGGCTAGTTCTCTCTACAACTTCTTCAATTTCGCCATTTTCAACGGATTCAGTATTCCACAA
ACACCAGTATGTAATTGGCTTATCATAGATGTTAATAATCTTTCCGTCGGAAAGTTCAATTTCAATAATTCCAGTATCAGGTTCTATATCATCTTCG
CATTCTTTTGCAAGTTCACGAACTTTAAAGACAGTACCTTGCTGCACTAAGTTCCGGCCAGTAATTACATAGCCCTGTATCAACACGATTAATTCTAAACC
ACTTATCTACTGTAATCATGCCCCATCTCCATATCAATTAAGTCATTTATCGTTGGTTCATTATATACTGTTTCTTCATCAGTGTAAACCGGTTCTT
CCGGCTCTGGCTCTACAGTTTCCCATCTAGCCGCCCACCAAGGTTTAACCCCGAAGCTTATTAAGTTCTTCATAATCAATCCAGGATTCTAATCCTG
ATGGCAAATCAGATTCAATTTCCCAAAGAAGCTCTTCAATTTTCTGAAGACGATCTAGTTCTTCGGCTGGAATAGTAACCATTGACGGAGCTCGTGA
TACATTAATATCGTAAATCATATTTACCCCAATTTAACCATACAATCGCCGTATTTCCACTTAGAAATAGACTTTTCACCATTAGAATAATAAACTT
CGAGTTTAGCACGATTATTTTTAATTTTTAATTTGAATAACCTTTGCTGTGTCATCAAAGTTCCATACCCATAATAAACTGCAACTTCATCACCTACATATACCGC
GCTTCCGCGGTAATCATGAATATAGTCATTTCCTTCGAGCATCATTTAAAATATTCTCGCAGTTGGTCAAATCCACCAATATGACTTCCATCAGGAG
CAAATACCTGGGGCATTGTTAAGCCGATTTGAGTATCACGACCTAGTTTAGTCAGAAGCTCAGCGATTTTCTCATCATCAAAAACACCCTTTTTCCGG
CATAATGTTGATAAATTCAAACGGCTGTTTCTTCACAGTCAAAAGACGTTTTGCATTATCACAATACACACATTTGTGGATGTTGCTATCATAACCA
TATACTTTAAACATATTATTCCTTAATTCCTAGTACTTGTTTAAAAGTCTCGTCGTAATCAAGACTTTGGCCCGTTTGTTCTTTATGTTTGTATATA
ATATCACTTACTTCTGATACGATATTTTTATATGAACGAGTTAAAGCAGATTTAAGCACGCTGTATCTATCAGGAAATTTACCGTGTTCATTATAAT
AAGCTATTGCTAATTCACGGACTGCCTTTTCAGCAGCCTCCATATATTCTTTACGCTTGGTCATTTTTAATCCAAAATATTATTAGGCATTGGTTGA
ACACTCACAAGTTCTTTAAAGAACTCAGTAGAGTCAGGCAATTTAACCATTTCCGGAGCATGCTTACTGAATTTATGTTTACATTGACGGCATTTAT
ATTCAAGCTCTGGTTTACGCCAGTTAATCAACTGAACTTGTTCAGTACCGCATTCAGGGCAATTAGGAACGTTTTAGAAGCTCTTTCACGTCGTTC
AACCATAGCCATAATAGCATCCCATGCTGGAGGTTTAAAATCTAAATCGTCGCAGCCGTGAATCTTTCCACGCATTTCCATATCATCTTCCTCACCA
GCCATAATAATTTTAATTAAACTGGAATTACTTGAAGCTGCAATGTCTTCTAATAAACGCTTTTTCATTTCAATACCTCAATAGCATTACGTAAACC
ATTTGCTTTTGCATTAAGAGCTTTTAACAATTTGGTGTGTTCTGCAATTTGGGCTTCAACTTCAGTCAAACGGGCATTGAGATATTCACGTTCTTCA
CTCAGATTATCAACCTTTTCTACTTTAGGCTCTTTTAACTGTCTTATATGTATTAGGGTTCTTCAGTTTAATTAGAATGCGTGAACTGTATAACA
TTGAACCATTATCTTCGGTTTCGTCATACATTTCCACTACGTCCATAATTTTTAACATCATGCGGAGTTTATAAGACAACGAACGAATAGTTTTGTT
GTGCTTATTAATTTCTTTAGCTGTAATGGCGCCAAGATTACGTGAGTAATAATAAGGAACCTGGATATTAATTAATACTGATGAACCACCTGGCTTG
TGTGTTACTTCATCAGCAATAACCCAGTCCTTAACATGAACTGTATTTGTACGGTCATCGCCTGCAGTAAACAGCTTGCGAGCATGCTTAAAAAGCA
TATTCACTTGGTCATTGAATTGACAAGCAAATTTATCAGCAAATTTAGTTTCAGGAATGGTAGATAACCAATCAGCCAAATGGGTCTTTTTAACATC
GTTAACAATAGTAAATTCAACAAATCAGTTATAGATGTGTCAGATTTAATGAAGCTCGGCTTCATAAAGTTTTTAATGTTATCACGAGCTACAGTA
GAAGATAACATACGAGAACGTTTAAACCATTCAAGCAAATTGCCTAACGAATGAGAAATAAGCGTTTTGAGTATCTTTACAGATATGATTTTCCTGAC
CAACATATTGAAGGAAATCACGAAGAATATTATTGATTACTGCTCTGTGCCCGATCTGATAATTACGGTGTTTAGTAATAAGGCTGTCAAAATAATC
AATATAATGTTTACGAGTTTTCATGTTCTTCTCACTTGGTTAATGATTTATACTCCGAGCCATCCTTGGCTTTAAATTACTTAATTAACTGTAAAGC
TTGTTCAAGACGATCAAGACGATTAACGGATTCTTCCCAAATCTTTTTAGCCTGCTCATATTCTTTCTGCGCTTTATTAGAAATTTCTAGAACTTCT
TTATAAGCTTTTTCTAGTGCAATAACTTCTGGACGAATTTCTACTGGTTCAGGCGAATCGTCAAGACATTCCATTAGTTCCTCAAGGGTAGTTTCTT
CTTTAGGAGTATTCCAATTTCATCACATTTTTGTTGGTAAATTTCTTTATCAGTCGGTGAGTACGCACACTTTACTTCACGGAGACTAACTACAAT
TTTATATCCTTCCCAACCGCATATATTCTTAAAAGGATAAGTATGAATATTTTCTACTGTTTCCATACAAAGTAATGCGGTCTCTAACTGACGAGTT
```

Figure 12(N)

```
ATATCGCTAGCAATTGAGAAAAATTTATTAATGTTCTTTTGATTAGCTTCTGGTGTAAAAAATTCATAATTCACAAAAATAGCTGCTTTATTTTTAT
CAAGCTCATATTCTTTTATGATAATCATATCAGAAGCCCAAGGATGGATTTGACGATAATCACCATAGCATAATTTAGAAGCTGATTTTAGAATTTG
CTTCTTGAAAAGTCTAAAATTACTAATCCAACGACGAGTAAAAATATTCTCAGGGTCTTCTTTATTATTAAGATGATAAGAATTAACATCACCGAAC
CAATTATATCCTACTACATCTTTAGTTCGTTTAATTTCTTTCCCAAAATTACCAAGAATATCCCGATTAACCAAATATGAAAGAAGACGAGACTCTT
TAAAGGTTTTCTTGATAACATCTTTATCTACACGGCTAGAAATTTTACGAATTTCATGAATAAATTTAGTAGAAGAAACAATACTTGCATCAACACT
ATTGAGCCATTGTGATTGATAATAGAAAGAACGATATTTTGACCAAACATCGGTATAGCTTTATCATCAATAACGCTATTGAATGATTTGATATATTCG
TTACGAGTCATAATAATCTCCTCAGTAGAAAGTAAGAACATTATACCACATCCTTGTGGCAAAGTAAACTAGTTCAGTGCATTTAGTGCATTGTTCA
GTTTAGAACGTTGCTTCGTGAGATTTTTGACTTTTTCTTGTGCTTTTTCTAGCATCTTTTCAGCTTCTAACACTTCATTGGTCGCTTTAACGAGTTC
ATCATCTACTGCCTTAAGGGACTTCTCAATCGCATCCGCGTGCCATTTTTCAACAGGTTTAAGACTCGGATTTTCAATAGGAAGAAAATTCACTTTA
TTGAATTTCCATGCATCTTTATTACCTGAACTATACATCCAAAATTTAGGATCATTTGACGAGTAATTAGATAAATTTAAGTTATCTTGCACTTCCT
GCTTTTTCTCTTGCGGGACTTCGTCCTTTCTCAAAAAATCGTATTTAAATGAAACGATCATATCAAGTTCATATGATGTTGTATCTAACTTAAATCG
TTCAAAACGAGGTAAAATCTTAGATTGAACAGCAGCAACAACATCCATATACTTAAATGCTTCTGTCAACTGTGATTTAAGACATTCACAAATTGAA
AGAGAATTTTAGTATTAGGCTTAAAGCTGATTCGCGCAGTTCGATTATTTTCTTTAGATGGTCTTACTTCCATTTGAAGAGTATAACCATCAAATT
TCAGATTCTTTAAGTTAATATCAGAACCTTTTAATCGACTAGCCGTAGACAAAATTTGCTTTAATTGTTTACGGAATAAAGCAATAAATCTCCATTC
AAGACGATAATGATTTGGATTATAAAATCCCGTTGATAGATCAACTTTACTTTGACCAACGCCTTGAACAAGTAGAGGATTTTTATAATCAACGGTT
TTACAGAAATCCATGAGCTGTTCACGGGCAGTCATTTGCGTAATATATCCAGCTTTATCAAAATGCCGCAACCATTCAGCGCTATTCAATGAGTTAA
AGTGAATATTACGTGTAACTTTATCAGGGTCTAAATTATTTTCACATAAAAATGTTATGACATTACGAGTATAACTAGCATTACGAACCATATCTTC
AATTTGAGAACGAGTTTTCATAGTATTCCTTAAAATTTAAGTAAATCGATAATTTTAATTAAATTTTCACGCTCAGATTTAGCTTTACTGCTTAATC
CAGACAATCTAAAAATTTCATCGTCATATTGTTGAATAGAAATATTTAGCTCTTCAATTTGCTTATTAAAATAATCAATTTGTTCAGAATGTTTTTC
GTTACTACGAACTGGTACAGGTTTTGTAGGAAATTTAGTTAAACTGGATTCATCCGGGCGATAAATTAAAATGCAATTTGAACCAATCGGGCATTTA
GCACCAGATGAATATTCTAACGTTCCAGCTTCTTTTAAAACTTCAAAAGCTAAACAGAGATGATGCCCCATATTAACATAATCTGTAGAGCGAGCTC
TGATATAATAATCATCGCCGCGAATACTAAATTTAAAGCATTTAAGGTCTTCTGTATTATTGGTCTTAAAAATCATTTGTTTATCTAGACCTTTAGC
TAATCGAGCGCCTAATGCTAATAATCGTCGTTGATTTCCCACAAATCTGCGATCATTTGGTCAAATGATAATTTCGGCATTAATCGACCATAAAGG
TCATATCCTTTATTATAATTGCGAAGGATTTCACTCGCATTAATACGAGACAACGCTCCAATTTTATTAAGGGCTTTCATGATGCGATTAGATAAAC
CCATTCCAGACCCGTTTGTTCGTTGTAAATGTTTATCTAATCCAAACCCAATATCAACTTTAAATTTATCTAAAATTTCAGCATGAACATCTCTGTC
AATAACATTCAAATCCAAAGTTGGGTTAAATCTATGAAAAAATTTATCTGGCTCTCCACGACGAAGTACAGTCCATTCATTCAATTTTTTATTAACT
AAAGATTTAATTACTGCATTGACATTATTAATTACTACTGACATATTTCCTCACTCAATTTCAATTTTACTAAATACGCAGAATATGATGGAAAAGA
CTATATAAGCACCGCATACAGATTGAACTAATACCATTCCAAAGAACCAAACAATATTATCAAACAATGTCTGTTTTACGTCGAAAGGACGTAAACT
TACAGTAATATTATCACCTTTTTCTATTGAAGAATACATCTCTGGGGAAATATATTCACTAAATCTATAACCATCTTTGAGTTCATATACGGCAATA
AACGATAAACTAGACCCTTTTCCTTGTGTTCCTGTAATGGTATTAACTACAGTAACATCATAATCTTTATAATGCATATAATCATTAATTGCGTAAT
AACCATATGCAATTACTACACATAAACAACATATCAATAATTCAATCTTTTAATTTGCATACTGTTTCATAATAATCTCAATTAAAAGGGCTTAGAA
CCATTATACCATCCTTGGTATAAAGCGGTTATGCGAGTACCGTCTTTAACCGTTCTTCAAACTTCCGAAGAGTATTCTGGCGTTCAGCTCTTTGCTT
TTTATAAGTTTCAATACGCTCTGAAATGAGAGTGTATCGTTCATTTACTGATTCTTTCATAAAATCAGGAATTTCACGAGAAGCTTTAATCTCGTCA
AATTTATCAATAACAGCTTGCTCTTCAGCAATTAAGTTATCATACATTAAAATATCTTTCTTGATAAACTCAATATCTTCTTGAGTTACACGAGATA
ATTTAGATGCTTTATCCTTTTTGTACTGTTCGTTAGTATCACGAGACCAGTGTAATGTACGATTTTTATTCGTATTTTTGTAAATTTCTACAATACC
GATCTCATCGATAATAACGATCCAATTCCAACGGGATTTGTAAATTTGTCCTCCATCAACAGTGATTTCACCTCCGATTGAGATGTCATTAAAGAAC
TTGCTTTGCGCTTCAGATTTAAATTTACCATCGTTGTAATTTACTAAGTTGAAAATATCTTTAGCGTTCATTTTCTGTTCCTCCGTAGTTGATAGTT
GTATAGTACCACAGAGGAACAGTCTTGTAAACCACTAAAAGAAACTTCTTTCACAATTTTTTCCACTGAACCATGCGCTTACCGCTTTCTTAGTCTC
AGGAGCAGTGTTATCCATAAACCATTCAAAGGCAGCCTTTTTATGATTCTGGAGGGCTTCTCGGGCTTTAATCTGCTCACGGTCTATTAACACTAAC
ATATGAGCCTTTCTTGTCACCATGGGCTTCTTATGATTTTTTGAATATTCCCAATCATTTGTCCATCGCATCGTTGTTGCGAATTGAAGTACAGCTT
CTTTAATTTTAGTTTCGTAAATTTCACGAGCCTTTGAGTATAACATCATTACCTCCATTTACCAGTTTAATTCTAGTCATCTTTTTGATGGCAGTCC
ATATAATCTATTTCTGAACTGCCTTTTGTCATAGAAGTCCTCTTATGAATTATTTCAGAAGAGTAACTCAGCGATTTCTTCCCAACCGTTTTTGT
CGGTCATAATAAAGTCAGCAAGATAAAGAGCAGTACGCAGTGAAACATTGCGTAAACGATTAACATTGACTTTCATCCATGATAATGCTTTATAAGT
TTCTTCATCAGAAAGACCGCGTTTTTGCATCATGTCAGTTGAAAGAATAACATCTTCAACCCTGACCATAATTTCTTCATTAGTGTGAACACCCAAA
TCTAAATAAACTGAGCGGGACACTAATGCTTGTAAATGTGGAGCAAGTTTAGTACCACGGTCTAATTCGCGGTCAATATCAACGTTTGTGATAAAAA
CAATCGTTCCTTTAAATTCAAACTCACGCTCAATGCCTTTTTCTTCTAAGTAAGAAGATGCGGTGCTCCAGCAGACTTTACGGGTCTCTCCAGTGTC
CAGAGCAGCTTTCAGAAGATTAAGAATGTCCATATCAGAGAAGAACATCCACATCATCAATCAAAAGGACAGAATTCTCTTCACGATTATTCCAAAGT
TGTTCATAAAGACCGATACCGGAGATTTTACCGTTAATGCTTTTATATTCAATGTATCCATTATCATTTGCTTTATTCAAAGCTTTATCTAAAGAAT
ACGTTTTACCAATACCCGCCGCACCAGAGATAATTAATGAACGAATGTTTCCGTTAATAATACCATTCGTCATCATTCCCATAACATTAAATCTTTT
ATTAATGCGGGTTTTCATATCTTCATATGATTCTTTAACTTCTTCAACTTTTACACCATCATATGAAATGTCTGATTTGTAAACCCAAACACCGCGA
CGCTTACCGTCAATTTCAACAAAAACTTTACCATCTCCTTGTGCATCTACCGGAGCATTATCTGGGAACCATTCACCTAAGAGCTCAAAAGTTCCAG
AGATTTCTTTACCGAAGTAGATACCCTTATTGATAGTTACAGTTTTTATTCTCCAATCTCACATTTGTTTTGATAGGGTAATAGTATCACAC
TACTACCCTTCTGTAAACAATTTATTTTAACGTTCGCCAAATTTTTACTGCTTCACGGCGAGATACTTCTACAGCTCCAAGTTCTACAGCTTTTTGG
CGTCGGCGAGCGTGTAAGTCATAATGTTTAATGCGTTTATCTTGAAACCAAGAACGTTTCATTCCTATTGCTTCTGCCATTTCATGAAGCTCTTCAA
TATCTCCATCAGTGAACATATGACAATTTTTAGTTGGATGACCGCGAAGTTTCCATCCATGATTCATTAAAACATCTACGTAAACTGTCATTGATTC
TTCTCCAAATAAGTTTCGATAATTTTCTGAGCGAGATAAACTGCATTATCTTCAGTTGCATCTTCTAAGAAACTTTCAAAACACTCTGAAATTTCTT
CTGTGTCAATCAACTTTTTACTTCAAATTGGTGTAATTTTCATTTTGTTTTTCCGTTTAAGTGTTTGTTTTGATAGTTGTATAGTACCATAAAGCTT
TATGCTTGTAAACAATTTTGTGAAAAATTTTTGAAATAAAAAAGGGAGCCCGAAGGCTCCCTATCATTTATAATAACTTCGGTGGTTTTCAAGATAG
ACCTTCTCAAGGAAGTCATCCCAGAAACTCATGTCTACTTTTGCTGCATACCGTTCTAGAAGCTTCAGTAGATGATGCTTCTACTTGATCGACCA
CATCTTCCAAAAACTCTTGAACTGTTTTAAATGGATGCTTACCCAACTTCACGTCGAGAATAAATGGAGCATCTTGGAGTGGATAAATCAAGTCGCC
AGTTTTGTAAATTTCCAATAGTTGGAGTCCACCACGACAAGCATGACTCAAAGCTTTCCAGTCAATACCTTCATTGGCTTCGGCCTTACGAGCACGT
TCACCATATTCAGCATCTAATTTGTTCAGTGACTGCTTAAGCTCAATAAGAGAAAGCGTTGTCTGATATTTACGACCCAACACAGTGTAGAACGTTT
GTGGGCCTGTTTTCTCATGATTATGGAACACCCATTCACAGAATTCGTTTTCTGGAAGACGATGCTTAATATCTTCAACTTTAGTGCGAGCGCTCTT
AATAGAACCATCTTCTTGGTAATCAATCCACTGCTCAGGGATTGATTAACTACTTTCAATACATCACGTAATGCAGCCAAACGAGAACCTTTGACA
CCGTATTTAGAAGCTTGCTTGCGGACATATCCTAAATATGATTTCATGTTAGTCGTATAAAAACGAGAACGGTTGTCTTGAATAAACTTCCACACAT
CAGGCAAATCAGATTTAACCACTAGTTCAGGTGGAGTGTGAAGCATATCCAATGCTACAGTTTCACCATCTGCTGCTAATTTAAAGAAATATTTAAG
```

Figure 12(O)

```
ACTGTATAGTTCATGGTCAATATCATCTTTAGTGTTTTTAGATGATGTGTTGTTAGTGTTTTTACTCATGTGCTCTTTAACATTTCCAATAAGAATA
TCACGAGCAGGAGGAACAAAGATTTCTTTAAAATCTACATCAGATTCTGGGGTAGAAGTTCCATAAAGATGACTACCAAAATAGCTTTTCATTACTG
TTTTCATCATTCAGCCTTATATTCAATAACAGGACATACTTTAGCTTTACGCGCTTTTAAAAATTCGATGATAATAGATTTCTTGGGTTGAATAGGA
GGTAAACCTTTATACGCCCTATCAATATTTTCTACATGTAAAGCATAATCCTTTTTCCATTTATAATCTTTATATTTTTCATGCAGTTGTGCAGGAA
TAACAAATGAACCAATAATAAGTAAAATAAGCAAAATGGCAAGTATAAATGCTGATGGAATAAGAGTCCATAAACTACCAAAAATAAGCCATTTCTG
TATGATTTCTGCACAGATAATAGTTAGACCTGCGAGTATAGTACATCCGAAAAAAGAAACGAAAAATGTAGGGATAACAATAGACCAAAAGTATGCA
CACAGTGTCTTAGGTCGTTTCCATTCGTCGTTAAACAGTTTGAATAATTTATAGTGCCAAGAGTTTTCATTAATAATCATAATTATCCTTTCATTGA
AGGTGTAACAGTTGTTAAATACTTAATCATAGCTTCAGCTTCTGATTTTGATAATGAAATTTCTTCATTGTTTTGACGAATAGAAATAAAATCCGGA
TGACGGTCACCACCAGCTTTTAAAACACACATATAAGTATCAGTTTCATCTTCAATATCTGAAATGATTGAAGCAGTTCCACATGAATGTGGTTTTT
GATAAATCAATACAGCTTTTCTTCCACCGTTTGACTGTTCATAAACTTTTAACACATCAAACAAATCGCTTCTTTTATCAATAGCTAAGATGTTGTT
TTCATCTTCAATATTAAATCCTTCGGATACTTCATAAGTGTCACCCATAAATCACCAATATCAATAACAGCGTTCACTTTTCCATGACTTTCAAGA
GCATTACAAATTTTCTTAATTTCATCATAACTCATTTTAATAATATCATCTCCTTGAATAAGGAAGATGTCATTTTTAAATTCAACACGAATTAAAC
CACTTCCACTTGAAATAAACATATTTCCTCACTTTGAAATCATAGTTGGAATGACAGAATCGAGATAAGTCTTTAGCGCAATAGCTTCGTCTTTGGT
AAATGTGACAATATACGATCGAAAATCATCAATTTGACGAATAGTTAAGACATCACCATCTTCATAGCATTTTGATACGTTTAAAACAGTTTCATCA
TTCTGATTGCAAGCGTTAGTAATAATAGCATTGCAATTTTTGAGCCATTTTAAACTATGTTTTCTTTCATTAGAATAATAAAAATATTTAATCTTAT
CTATAAAACTATCCCAATGAATAACTGATAAACACATTGACTCACTTTTAATATTAAATCCTGGGCATGAAGAATAAAAATGAATTTTGTGCTCATC
ATTGATGCTTACTATTTTATCAGTATAAGGATATTCAATTTGGGTTAAATGAATGATTTCACTAGGCGTAAAATATAGCATATCGTCTTCTTGTGTC
AAACGATACATATTATTTACTTTTTCTATAGCTAATTCACCAAAAAGCGGACTAACTTCTAATACTAATCGTTTCATATTGATTCTCTTCGACTCAC
CCACAATTACATACTCCTTTGAATAATATCAATAATGTTGTTCACCAGATTATAAGTAAACATTGGATAATTATATTGAATCATCACATACACACA
AACAAAACTTTCATTCTCTTCTCCTTGGCAGTTGACAAGATTACTATATCATAACCTTGCCAACTTGTAAACCATTAAATGACGTTTTCAATAAAAT
TCTGAAGCTTTGTGTGAGCATCAACCATGATTTTCATTTCTTCCTTTGCGAAAGCTGTACCTCTTTCCCTAGCAGATACTCATAGTCAGAAACTGC
ATTAGCATATTCTTCAATTAGCTTCATTAAAAACATCTGCTTTTCAGTTTTCATTATTCCACCTAATCATTTCAAGATATTGAACTAACTTAGCTTT
GGATTTATCCAAATCCTTTTTAGCTGCTTCTATACCATCGTATGAGTATCCTTCACAATGCTCAACTGCTAATTGATATGAATCTATTTCAACATCA
CGTGCTAATTTAATAATTTTTCAAACTGTTCACGTGTTAGCATACTTAAACTCTCGTATTATGATCGATAATTTCATCAAGAAACATATCTAAAGCT
TCTACAGCATTATCAACTTTAGCTTCAAATTTTTCAATACCTTTATTTGCAATGCCTGCCGAAAACCAAGCAAAGTCACTAAGTTCCTCATCTGCTT
TGCGAATTAAAGCTACCAATTCTTTAATTTTATCTGCTTGTTCAATTCTAGTCATTATTCCACCACATATGAAAGAGAGAATATTGCACACGCCATA
TGAGTTGCAGCTTCATCACACATATCATAACGTTTCTTAAGAAGTTCTACAAGTTCTTCACTAGTAACTTCATCCATGTCGACGAAAAAATCACCAT
TAATGATGACGTAGATATTTCCTTCTTGATTGAGTGCTTCAATTTTCATGATGTTCTCCTCTTTATCCGATGGTTGTATAGTATCACAGCTCAAATT
GAAAGTAAACTGGTAAAATGAAAAAAGTCTCCCGAAGGAGACTAATGTTATTCGAGGGAAAGAAGATATTTGCTCTGGTAAAACATCCCAGTAATAT
CATCTATCGTGCTTTGAATGGCTGGAGGCATTTCTTTATAAATGCTGTTAGATTGGTCTAGTATGTGATCAATCATTCTAATTGTGTCGGTAGGAAG
TTTACTGGCATCTGGAATAGAAGGCGTGTATTTTCTACCAGAATACCCCAAATATTGCTCACCAAATTTATCAATCAAATCTGGCAACTCAGAGAAA
ATAAAATCGTATGCTTTGTGTCTAGCATAACTTTTAGTTTCAAAATGCGCAGAATGAAAATAAGCTTGTGCAGCCATTAATAAACCTAAGTATTCAT
CTGCCTTTGAAGGTTTTCCACTTTGTGAAAAGTCGCTGAATTTCATTCAGTCTCCAATTTAATGTTCATAATTCTAGCGTATGATTGTGCCATCTCC
GCGCCTCGCTCTATACATTCAAAATCGGAAGAGCACGGGTCATTTTTATAAGTCGTTCGCATAAAACTATAGAACTGCTTGCAGATGATTCTACGCTTT
TATTTTCAAAAAGCATATAAACGTGTCTAATACCAGATTCCATAAATTTATCAAAATGAGGATCGACATTCGCTTCAATTGGTGGAGATAAAGCAAA
CGCTAATCCTAGCATGGCAAATAGTGCCGTTGCTTTAAGGCCATAAAGGCCTCCTATCATTTTTGTCCTGTATTTACTTTATGCGATGCACGGCC
TTAACTTTATCAAGGTATTTTTCAAAATTTCGCAATCTAGTATAGTCTGCGGGAGATTGGTTGAGTGATACTTCTCGACGCAAAGCTGAAATGATAT
TTCCAACTTCCCTACGAATTTCATCTAATTGAAGAACAGTAAGATTGCGAAGTTGCTTTTCAGTTAATTGTAGCATATATACCCCTTTAGTTAGATA
AACCTATTTATAACTTTTGCACTAACCGAGCTTTTTAGTTAATTCATTCCAATGTTTTCTACACAAAGAAACATAAATTTCATCACCAATACAGATT
TGATTACCTTCTTTAACTGGTGTTCCATCTTCCATTAATCGAGCTGTCATAAGTCTTTTTACCACAATGACAAACTGCCTTTAGTTCAATAAGTT
TATCTGCAATCGCCAAAAGTTCTTTAGAACCTTCAAATAATTTTCCAGCGAAATCAGTCCTTAGCCCATAAGCCATAACAGGAACATTATATGTATC
AACAATTCGACTTAATTGATGCACCTGTTCAGTTTTTAAAAACTGAGCTTCATCTACAAATACACAATGAATATCTTTTTGTGCTTCAGCCCATTTA
TAGAACTCAAAAATATCCATATCATCCGTAATAATATTCGCTTCCTGCTTAATTCCAATGCGAGAAACGACTTCACAGACAGAATCACGAGTATCAA
TAGCAGGCTTAAGAACTAATACACCCATTCCGCGTTCTTTATAATTATGTGCAGCAGTCAAAAGAGAAGCAGATTTTCCAGCATTCATTGCTGCGTA
AGTAAAAATTAAACTCGCCATATCACCTTTAAAGCGTATTCACATAAGCTATTAATTCGTTTTTCTTTCTTATCAAACCGATCAGCAAATTCTTCT
TGCTGATCGGGAGATAGCGGGCCGTATTCATCATAAAAGGTGTTTGCTTCTGTATGCTCATCTAGAAGTTCATGGATAAGCTCAAACAATTTATCTT
TTTGTTCTTTACTCAGACTCATATATTAATTTCCAGGAGTTTTAAAATAATTCGCTTTTGCTTAAATATTTCCATAGTTAAATGACCAGTATCTTTT
TGACCGATTCCAATGGCAAAACCTTTATTGACAGCGAGTTCAATTAAATTATCAAGCTCACGTAACACTTCATATTGTAACTCAAAACTATTCATTT
CGGTTTACCTTCTTTAACGAAATCAGGATAAGGATAAAATCCTGAATAAAATCCTTCACCTTTATGATTGATGCATCCTTTATTAGAACAATAGCAC
CAATAATCGAATACACAAGCCATTTCATCATTACATAAAGCAAAAACAACTGGCCATTCACACTTTTCGCAGTGGGCATTTTTAAGAAATACTAGTTT
GGCTCATAACCATGTAACCTTTAAACAATATTCTTCTACATGTGTTACGACCTTTCCTATCAATAAAGGTATATTCAACGAATGTTCCAATATAG
TCTTTATCTACATCATGTGGACTATTAATTGGGCATTTAGTACGGCAAATGCGTTCCCATTGACGAATAATTTCCACTTTGTTTTTAGGATCAAACG
GATGCGGGTAATGTACTTTCATAATCCACCACTATTAAATCAATATCAGGAGTAAACATGTCAATTAATTTAGAAACCTTATCCCAATCGCCGCCAG
CAATACCGCAACCTATGCGTGGAATGTAAATTACTGGTTTAAACAAAAGGGTTTCTGCCTGTAGATTTAATTCTATCATGCAGTTTACTAAAGCACC
ATAATCAAGATTAGGACCCGGTTCGTATTGTGTATACAGGTTATAGCATACCAAATCCCGTAGGACTATGTGTTTAAAAACAATAGACATATCGCCT
AATTTATCACGAGAACCGTACTCGGTAGTGGTTTTATCTATTTCTAAAATTTTGGGATAGGCTCTTGCTAATTGACCCGCTACGCCAGAGCCCATTG
TGTGGAAGCAATTGCACCCGTGCGCAATAATATTACCTTGAAGAAATAGGGCGACAATATCGCCCTTGATATATTTTACAATCATCTAGTACTCAAT
CCTCGATTATAAGAATCTACTAAACGGTCAACCATTGAATGACAAGCGGCTTTATCTTTCTCCTCCGCAACTGAACATTCTAAAGTATTCCACTTTT
TAGCATATCGTTTTAACAATGTATCATTTTTATATCTGCTTGATTTATCTCTTTCTCCGTCTTTATATGCATATATTAATTTCTGCGCAAATTCAGC
TTGGCATGCTTTATTTTTCCCACAATAATCCGCGGCAGTACGGTTTACATAATCTCTAATTTCAGTATATGATGTATCTGCTAACACAGAAAATGAA
ATTAATCCTATACATAAAACCAAAATTTTAGTCATTTACTATTTCCAAAAGTTTATTATTTTTAAGGTAATTAGCCTTTTCTAGGACTTCAGAAGCA
TATTTAGAACCTGCTTTAACATTCCATCCCGAATTATAAGAGGATATCGCCTTTCTTATATCGCCCTTATGTATATTTAACCAATAAGAAAGTTCAA
TGTACGCCCAGGAAGCTGAATTGGACCGTTTATTCAACATTCTTTTTATTTCAGCATCGGTCATATTTATAACCAAGTTCCTTAACTCTTGCTCGCAT
AGTAGGCAAATAATTTTGGAACATTCCATAGGCATGATGCTTGGTTTAGATTTAAATTAACTCCGGCAGAGCTTTCTTGCCATAAAATAGCAGCC
ATTATATGACCTAATCCGCTCTTGTGGATATTTTTGTGTGTTTTATATTTTCCATCCTTAGAAAATTGTTCCCCGAATTGATACGCGTAACGCATGT
TATCGAGTTGGACATTACTGAAAGTATGCTCGGAGCTATGTGCCATCATTGAAATGGCCAATAGACCAGCGAGTAGTGCTTTTCTCATGCTTACCTC
```

Figure 12(P)

```
ATTGAGTTTTAATTACTGCTTTAGAAGCCTTTCCTGGTAAACGACGACTGTTGATAATTGCCATCCTACATTGAAGTGACGGGTCTTTGAACTTTGC
GTTAGGTTTACAAACTGTAAATCCAAGCCAAAGATTTCCATCTGTGATTTCTAAACGTCCAGGACGATATTCAACCCCCTCAATAAAATCCTCGTCA
ATGTCAGGACGCGGAGGCATACTCAGGAATTCATTAACTTCTAAAACATGGTCTTTTATTTTATGGAATAATTCAAAAACATATGTCTCATCAATCT
CCCGTTGAATTGCACGATCAAGAAGATGTTGAGAATATTTTAGATGAAACGATGAGACTCCTGCTGCTTTTGATGCCTCACGAATCTCATTGTTAAT
TTGACGAAACTCCGACTCAAAGTGACGACGAAGCTTATTTCGACGGATAAAAACTTCTGTATTGATAGTCATGTTATTCTCCTCTTAACTGATAGAA
AAATTATACCACAGTCAAGAGGAAAAGTAAACAGTTATTCTTTAAATCTAATCAATTTATTCATAGACTTTGAAACTTCTGCACGAACCTCATGTAG
ATTTTTGAGCTGTTCAAGACGCTGCTCATAGTAAGCAATTTCATCTTCTTCGAGACAGTCCTGTGAATCTTCTTTAAGATAACGTGCATAGTCCTGG
AAAGCGTTACGAACTACTTCCTGGAAGTCATCAAGACTTTGAATTTTCTTAGGAGCAACAGATACACGACGAGGGGCAGTATAATACTCATAACCAA
ACCCTGCGCTTAATTGAGCCATTAGTATTTTTCCTCTGGTTGGAACGCTGCGCGACAAGCCCACATACTGGCTTCTTTGAGTTTCATTTTAGCAATA
GTTAACTGATCGAGGCTTTCGGCGTAATTCTTCGCGAGTTCATCATCTTCACGACTATCAAATGCTTCCCAGAATTCATCATATAAAGCATCAAAGA
TAAGCCCTAAACGAACTTCAGCATCTTTGATAGCATTCACTTTACTGATTTTATCGTCAGTATGTGGTTTATAACCTTTAATGTCTTCAATCATATT
TTACTTCCTCACCTGTTCCCAAATCATATTCAACTAAACGAATAGGTTCATGAATGCCATATCCTTGAACAGAAATTTCTGTCGTAGGATAAATTCC
ATTAATATCACCCATGTTCCATGCTTCGTTAAATTGCTGTTCGCCTGAATTACTAAACCACTCGGCGAAAGCATTTAGCACATCTTCAGAACCTTCA
ATAATTATCTTTGCCATTACAAACTCTCGGTGAAGGTACGAGCGATAACGTCGCGCTGCTGTTCCGGAGTCAGAGAGTTAAAGCGAACTGCATAACC
GGATACACGGATGGTCAGCTGCCGATATTTTTCCGGATGCTTAACTGCATCTTCCAGAGTTTCACGACGCAGAACGTTAACGTTCAGGTGTTGACCA
CCTTCAATTTTAACTGTAGGCTGTTGCTCAATTTCAATTTCACGGGCATGCAAACCATAGAAAATTTCTGGGTCTACAAAAGAGTCCTCTTTAAAGG
TTTTAGAGACAATAATTCGTGCTTGAATACCATCTTCAAAATAAAGTACCTTTATGTGTGCCTTCAAGAATTTGATATGCTTTCATATAACCTCA
ATTAGAAAATAAATTTATCCAAGATTGTTCTTTAATTAAAAATGGCTCAGAATCATATGCCATTAAACTCTGTGTGATTAGTCCTTTAAAAGGCCCA
TCAATAAATTCCATGGTAAAATATGGAATTTTATTCATTAGCCGTGCATTAGGAGCCGTGCACAAAACTCTGCATCCTTTGAATACGCCTTTTGTA
ATTTGTATTGCTTGGGATAAAATTCGCTCAAAATGTTATTTTTTGCCAAAATTTCAAAATGATTCACCAATTTATTTTTAATAGTTTTTGGCGAAAA
ATAAAGATATTCGAAAAGCTGAGTGTCTGTCATCATTGCATTCCGATTACGAAAAACTGTGGACGAGTAATACCACCAATGCAACATTTAATATTAC
AGCAGCAGTGTACAGTGTCAATATGGACACTATAAATCTTATCCATATCAGGAGATTTGACAGGCTCATCAATTATATACAAAATTCGCGAAAGCGA
TAAACCTCTGAACTTGCTTCCTTTATTACCAATAAAACTGCGCACAGAATCAGTAAATAAACGAAAACGTATATCATCATTAGAATAACGCGAAAAT
TCCTTTTTAATATTATCTGCGGAAATTTTAGCGTAAGCTGAAGTATTAGAAAGAACAATAACTGTTCCACCGTCATACAACCAATTAGCCGGCAAAAT
TAGTTACTGCAGTTGATTTACCAGATTGACGCCCACCATCTAGTCGAAGTGTACAATACTGTTTAAGTAAGTCTTCAAATGGCGGGATATATTCGTT
TTTACAAATTTCTTCTACTCTAGCATCAGAATGGTGTGTAAAAGCATTCATCAGGGATAGATAAGGACCAGTTAAAAATGTTCTCATTTTGTTCTCT
CTAGGTTTGGGCCATTCCATGGCGCATGAATTGTCCATTTCTGTATTTACCCATTACCGCACTTGGGCTCGACCTTATTACAGGTTGGCGGGAATCC
CTCACAGAATCATGAGGTCCAGGTTATTCCCATGTTATTTAAATGTAAATATTTTTGCCGTAATACTTATACCAGTGTGGCTTCATTAAAATTTTTT
CATCGAGTCGTTGTTGACTCAACTTAATAGCTGATTTGCATGGATTATAATCATTTTCCATTCTACTGGAATATCGCTGATGTCAGGAACTTCAGT
ATCTTTTATACTGAACCCGCGTTTTAAGCATTCCGTTATAATGTCCGATTGACGCTTTCGCCAAAAATTCTAACTTATCGTAAAAGAAAGTAACATGA
CCAGAACCTAAAATAAATTTAGAAGATATTTTAAAATCTTTAACGCGCTTACCGTTTGCCACATGCTTACGAACTATACCAAAAACACGCGGCAATT
CACGGTATTCTGCGATTAAATGTTGATCAGCAAGTTCAGATACTAAAGTCAAATTAATACGAGTCATTTTATCCTCCAAGTAACTGTGAATATACT
ATCACAATTCTAGGAGAAAGTAAACAACTTTATAGATTTTTATACGCGTCCCAAGTGCCAGTTCTAAACGTTGCAATGACTCGTTTTGCGCGATTAG
GTGTTTGATTATACCATCTACTTTTAGCTAAGTTAACTGCTGCTTCATCCCAGCGTTTTTGCTGGAGCATGCGTAAAGAATTAGTAAATCCTGCTAC
GCCGGTTTCCCCCATTTGGAAGACCATGTTAATCAATGCACAGCGGCGAACAGCATCAAGAGAATCATAAACTGGTTTTAATTTAGCATTTCTCAGA
ATTCCGCGAACAGCAGCATCAACATCCTGATTAAAGAGTTTTTCGGCCTCATCTTTTGTAATTACACCATTACAATTACGCCCAATAGCTTTATCTA
ATTCAGATTTAGCAACACTTAGTGATGGACTTTTTAGTAAGCAAATGACCAATGCCAATAGTGTAATAGCCTTCGTGTCTTTATAGATTTTGAGTCT
AAGACCTTCATCTATACGTAACATTTCAAATATATTCATAATACCTCCTAAGTATTTATAGAAGGTATTTATAAATTAAAAGAGGCTGTTCATTATT
CGGTAAAGTGAAGGACCCATCACATATTGCCACTGAGTACGAGGAATAAGAGCAAAAGCATCCATCTCTGGAATCATAACGCCATCTTTATTTTCAA
AATAAGACTCGCAATGGCAATTTCTAAACATCTCATGCTCTACTGGAATCGTATAATAAAATAACTGTAAGTCTTTATTACTAGAATATTTAAATAC
ACCTAAGTCTTCTAGAAGGTCTGGATTATAATCGATAAAACCAGTCTCTTCTGAGCATTCTCTTTTTGCAGCTTCCAGTGCATTCAAATCAGAACTT
TCTACACGCCCCTTTGGAATATCCCAGCGATGTGCAATCATTCCAGGTTTACGAGAACCGGTAACTCGTCCCATAAATAAATCTTTATCTTCTGTCA
TAAAGATAATACCAGCTGATAATGTTTTCATTTTAATTTCCTGCATTCAGTGATAAAATTATTTAATTTTTGAGCATATTTCTTTTCATCAAAAATC
TTTTGTTGTCTGCGTAGCCGCCATGGCATTTCAATGAACGTGTACCATATCCCAGATAATATTTGATGCTGTAAAAATATTAACAAGTATGGTTAAAA
GAATCCAATCTCCTATTCTGTCCATTGGATTTTTTATAAAAAAGTAAAATACGAATGATGACACAGGAAGACTAATGATATACCACAGAATCATAAT
CTTATCTGTGAACCATTCAGCATTCGTTAACTTAGCACGACCATTATGAATACACACGAATTTATCATCTGTTACAGTAGATGGCTTAACTGCTTGA
TATCCCATTCTAAACTCCCTAATTAATCGTTTCTTTGTATCTTCAGAACAGCCGCTCCAGTCAACTCTATCAACTGAAATGCCATCGTCCCCATCAT
CTAAATCATACCAGCGAGTTTTTAAAATCATTTAATTTTCCTACAATCGCTCACAAACTCTTCCATTGATTCTTTTTCAATATAAGACATATAGCTA
TTATATTCCTTTAATTGTATTTTGTAATCCTTTTTCTTTGCCAATTTATTTTAAAATTATCATAATGAAAATATAACATGGTACCAAAGAATGAAA
ATAATGAAATCGCTATAGTAAAACGAAGTTCACTCCAAACCTCTGTTATAATTACTGTGCCGTCGATATTTAAAATAAAACAGTCAATTAACAATCC
AATAAGACTACCCGCAAGAGCTGTAAATACTGATACAGCAAGAATTAATAGTGCCTCAGGAAACGAATATTTGACTTTATTTAGTTTTGGCTTTTGC
ATCGTGATTCCTTAACAAATTTCATAATTTCATCAAATTCATACATATCTAGCTTAAGCTGGTGTTCCTTTTTAATCTTTTTACACTGAGCTTTCCA
ATCACGTACACGTTTACGATAATGTCTTCCTGTGATACCAGTGTACCAATTTACGGTCATAATAAAAGCGGAACTACCAATGGAAGAATTAGT
GTTGCTCCAAATATTGCACCAGATTCAATATCAGTCATAACGTCTATAACCATTCCAGCAATCACCAGAATCACAAATGATACAACTACCACAGGAC
CTATTAACACATCAGTAGAAATTAGCTGACGCTTTGGTTCATACTTCACAGGTTTACTTGGAAGGTATAGTGATGGCTTTGACATATTCTTTACATT
CCTTAACAAATTTTTCTAATAATAAATCGCTTTCAAAATTGGGATTTTCTACGAATTTATCAAAAAGATCATCAACAATAGTTAAGATATTCTTTTT
ACTAAGAATACGCTTATTTTCATATTTTGTTTCAGAGTCAACTATAAAAGTAAAGAAATATTTCTTTCCCTGAAATTTTACCGTAGTATCAATATAA
AATAAATTTGATTTTTGTAAATTACGTTTAAACCATGCATCATCCTTAAACTATAAACGCCAAGAATATCATAATCGTCGTTTAAATAACAAACCGTCC
ATTCAGGAGAAATGAAATCAGTAAATTCAACATCAAAATCACACGTCAATGAATGAATTGATTCAATACTGTTAATGAGTATTCCAGGACGTATTAA
AGACTTTTTACCTCTAGAAAATCTTCCGGAAAGGCTTTCATCAGTTTCATATGAAGACCCCCAATAGTAATTACGTCCTTCTGCCATACGTTTAAGA
GCATTTAGTAATTGATCTGGAACATCAACCTGTCTTTGGAACTCTTCAAACATTGAATTGAAATCACTTTGCATTTTCATTCCTATTTACTCCAAGT
AATAGGGGCCGAAGCCCCTTATCATTATTTCAGAGAATTAATATATTCCTGGACATCGGCAGAGGTAGTTTCAACCCCAGAAATATTGCCGTTAAAA
GTTTCAACTCGAGCCAAGGGTATCTTCAATATCAACCTTAGTCAGTGCTGCAATTTCAACTACATCACTCGGCAGTACTAATTCCAAGGGCATTTGCCG
CACGAGTTTCACGGATATATTCCAATTTAACCGCAAGTTCTTGACGAGCATCATCTAACTCAACTACTTTCTTGGCGATTTCAATTCGGCATTTCAGC
ATAACCGTCAGCCTTAGTAGTCAACTGCTCAGCTGTTCGACGATATAGTAAACCGAGTTTAGCATGCATTGTTACATCTTGGCCTTCGGAAGAAGT
TTACGAATTTCACGCTCTTTTGATTCGGCCTGTCGATTCTTTTCGATAACAAGTTCACGAATACGTTTTCTTCGTTAATAGATTTAACAGAAGCAG
```

```
CAATTTCAGCCAAAGTTCCTTGCAGAATTTTGGATTCTTCCATCAGACGAGCCGCTTGGTCCTGCGTATCAAGAATACGAGATTTCAGAGTTACGAT
TTCAGCAGACAGTTTTTGTTCAATAGTTTGTTCAGACATTATAGTACCTTTAGTGTATTTTTAATTTTAGAAAAAAGTTCTTCAAGAGAACCATCGT
TTGTAATTACTAAATCGCCATCACGAATTGGCAATCCAGCTTCTGTAATATGTGTATCATTGGATTTTTGACCAGGACGAACTACATGAATTACTGT
AGCACCCATCGCCCTAGCCGCATCCATTTCATGATCTTGACGGGTATCAGGAACGATATAATAATCATAACCTGAGTTAAATTTATCAAGATAATCT
AAAGCAAATAATTTTACCCAGTACATGCGGTCGAAGTTATTAACAATCAAATCCGTACCTAGGGCTTGCATCAGACGACGGACTGACCATTGATCTT
CAATATTATTTATAACGTCAGTAATTTTGTTAAATGCTACGAAATTAACTGATTCTTTTCCTTCGTCATCAAAAACAAACACACCTTTAATTGGGCT
TTTACCATTAAGATAGCAAAATGCTTGTTCCATAATCGTGATTACTTCTAATTTAGTCAGATTTAAATTAGTCTCACGATCATAGTCAATTCCTTCA
AACTCTTTACGAGTTAAGCAAGGATAGTCGGTGTTTGCTGCAAATACTCCCCATGCATAAGCCAATGCATCCTTAATAGGACCAGCAAGTTGGTATT
TAACTGCAGAATAATTACTCATGATAAAATCAGCAGTAGTATCTTTTCCACTACGCTTTACACCGCTTAAAAAGATTAGTTTCATGTGTTTCTCCTC
AAATTTAATTAAGATTATAACACACAAAGCTGAAGCATTAAACTTCTGCTATAATTTTACCATCTTTTTCTACTTGAAAATAGGTGTAAGGAATCGT
TGCTGTACATACTAAAGCCGGGTCTGAATCTTCCGTGTAGCTAAATTCTACTTCAGATAGGTCAGAAACCCAAGGCTTATAAAAATTTATTGACATC
ACGATTTCAGTTTTACTATTATCTAAAATGTAAAGCGTAATGTATTCAGGACCTGTTTTTTGGGCAGTATTTTCGCCTGTAAGATAGTTACTAGTTC
CTAGCATCCATTCATACATTCCTATCCACGACTTAAGCTCTTCGTCAACTATAAATCTCACGATGAGTGGATCGTACTCAAATGTAACACCTGGACG
TTGTGCTCGACCAAGTCCAAACGGCCCAGTCACGGTATCAGTAACAGGTATTCTAATTCCTGGAATAGGAACTGACTGAGCATTTAAAGTAAAAGCA
GATGTAGTATTACTATGTGGTATTGATACTACAAAGTTAGTTGTATTTGCTTGGTTAAAAATTTGTTGCAGTGCTTGCGACATATATTCCTCATAAT
GCTTTATAAATGTTGGTGGTATAATGGGTCTAAGTCCCTTCCATTCAATTCCAATTAGAACAAACAATAGAAAAGAATGGAAGATAATAGAATTAGA
TATTTGACCAGACTTTGTTTGCAGAGAAACGTTTTCCTTTTGAAACGAACTGCTGAAGTGGCATTAACACAACGTTCGCCCAGTCTTTCGGGGCGAT
TTCAACAAGGCTACCCATAATATTACCGGGGATATATGCCTTAATCATTTGGTCTGCACCCCTAAATCCTTTCACTTGACTCCAATCAATTTTTAAT
TTAGTTTTATTAGTAATAGTAGGTGTATTTGAATATTGCTTTAAAAGCTCTTCTAGAAATTGCTGACGAGCTTTAGGTGGAATATAGTGCAAGTTTA
ATCCGTACATTAAATTATGTTTACCTAAACCAAGGTAAATTATTAAAGGAAATTTATCCCAGTAAGGAAGAGTTTCCTTGTGTTTAGCATCATAAGC
AAAAGCATATATTCGTCCCGGCTGCGGGCGAACAACTTTATGTCCTTTTACTTGCTTAATAGTTTCAGCAAACCACTTTCTGGTTTTATTATTAATT
GCTGCGCCTTCATTACGAATTTTATCACGCAATGTTTGTCTGAATGAATTTATCATAAGCAGTTGTCTTCTTGCTTATTGAGTTTATTCATTGGTT
TTGATTCAAGCTTTTGAATCTTTTCAGCCGTTTTAATTCCTGAAGCATATTTTGACATTGCCGAAGTAAACGTAGAGTATTTGATTCCTCTTTCTTC
AGCAAATTGCTTTCCTGTCATTCCTTTTGCTTTGGCCTTTCTGTATTCAAGACCTATCTGAATCCATTTCTTTTCGTTTAATGATTGCTTAACCTTT
GGAACTTGGGGAGTGCTTTCATTAATTATTTGAAAAATAGCCATTATGCCCCCTAAAGCCAAGAGCTCGTAATCCATCTTCTGTTAGAATTCTAAA
TTTTATTCCACGCTTTTCAGCTAAAGATTGTGCTGCTTTCCATTTGTCGGTATTAACAGAATATGTATAAATTTCATTCATAAATCTTTTCTTCGCT
GCGGTTGTTAGATGTGCTGGTTTAACTGGTGGTTGTGTTTCTTTTTTAGGTTTTATTTCAATAAAAAATTCTTGTCCAGAAGAATCTTTCATCCAAA
TATCCATGAAGTATCTACGTTTTTTCCCTTCTGCATTACAAAAATAAGGAATTACTGCTGTTTCACTACCCCATGCAATAATTTCTGGATTTTTATC
TAACCATTCAAAAAAGAATTTTTCCCAATTTGATCTATACGTAATTTTTTTAGGGTCACCTCTATACTTTGATATATTTTTAGGAACCCATTTTCCA
GAATATGCCATTGGATTCTCCTTATAAATAGATAATATATTTATAAACAGGAGGGCCCATGCTCTTTACATTTTTTGATCCGATTGAATATGCGGCC
AAAACGGTGAATAAAAACGCGCCGACTATTCCTATGACAGATATTTTTAGAAACTATAAAGACTATTTTAAACGCGCTCTTGCGGGATACCGCTTAC
GTACTTATTATATCAAAGGTTCACCACGCCCGGAAGAATTAGCAAATACTATATATGGAATCCGCAGTTGTATTGGGTTTTATTGATGTGTAATGA
TAATTATGATCCGTATTATGGATGGATTACTTCGCAAGAAGCTGCTTATCAAGCATCTATACAAAAATACAAAAACGTAGGTGGAGACCAAATAGTA
TATCATGTGAATGAGAACGGTGAAAAATTTTATAATTTAATATCATACGATGATAATCCATATGTTTGGTATGACAAAGGCGATAAAGCTAGAAAAT
ATCCCTCAATATGAAGGAGCACTTGCTGCGGTCGATACGTATGAAGCTGCTGTTCTTGAAAATGAAAAACTTCGTCAAATAAAAATAATAGCAAAATC
AGACATCAATTCATTTATGAACGACCTTATACGTATAATGGAGAAATCTTATGGAAATGATAAGTAATAACCTTAATTGGTTTGTTGGTGTTGTTGA
AGATAGAATGGACCCATTAAAATTAGGTCGTGTTCGTGTTCGTGTAGTTGGTCTGCATCCACCTCAAAGAGCACAAGGCGATGTAATGGGTATTCCA
ACTGAAAAATTACCATGGATGTCAGTTATTCAACCTATAACTTCTGCAGCAATGTCTGGAATTGGAGGTTCTGTTACTGGACCGGTAGAAGGAACTA
GAGTTTATGGTCATTTTTTAGACAAATGGAAAACTAATGGAATTGTCCTTGGCACGTATGGTGGAATAGTTCGCGAAAAACCGAATAGACTTGAAGG
ATTTTCTGACCCAACTGGGCAATATCCTAGACGTTTAGGAAATGATACTAATGTATTAAACCAAGGCGGAGAAGTAGGATATGATTCGTCTTCTAAC
ATTATCCAAGATAGTAACTTAGACACTGCAATAAATCCCGATGATAGCACCACTATCAGACATTCCAACCGATGATAATCCAAATATGTCAATGGCTG
ACATGCTTCGCCGTGATGAAGGATTAAGACTAAAAGTTTATTGGGATACTGAAGGATATCCGACAATTGGTATTGGTCATCTTATCATGAAGCAGCC
AGTTCGTGATATGGCTCAAATTAATAAAGTTTTATCAAAACAAGTTGGTCGTGAAATTACTGGAAACCCAGGTTCTATTACGATGGAAGAGGCGACG
ACTTTATTTGAACGTGATTTGGCTGATATGCAACGGGACATTAAATCACATTCTAAAGTAGGACCAGTCTGGCAAGCTGTCAACCGTTCTCGTCAAA
TGGCGTTAGAAAATATGGCATTTCAAATGGGTGTTGGCGGTGTAGCTAAATTTAACACAATGTTAACTGCTATGTTAGCCGGAGATTGGGAAAAAGC
ATATAAAGCCGGTCGTGATTCATTGTGGTATCAACAAACAAAAGGCCGTGCATCCCGTGTTACCATGATTATTCTTACGGGGAATTTGGAATCATAT
GGTGTTGAAGTGAAAACCCCAGCTAGGTCTCTATCAGCAATGGCTGCTACTGTAGCTAAATCTTCTGACCCGGCTGACCCTCCTATTCCAAATGACT
CGAGAATTTTATTCAAAGAACCAGTTTCTTCATATAAAGGTGAATATCCTTATGTGCATACAATGGAAACTGAAAGCGGACATATTCAGGAATTTGA
TGATACTCCTGGGCAAGAACGATACAGATTAGTTCATCCGACTGGAACTTATGAAGAAGTATCACCGTCAGGAAGAAGAACAAGAAAAACTGTCGAT
AATTTGTATGATATAACCAACGCTGATGGTAATTTTTTGGTAGCCGGTGATAAAAAGACTAACGTCGGTGGATCAGAAATTTATTACAACATGGATA
ATCGTCTTCACCAAATAGATGGAAGCAATACAATATTTGTACGTGGCGATGAAACTAAGACAGTTGAAGGCAATGAACTATCCTAGTTAAAGGTAA
TGTTACTATTGTAGTTGAAGGTAATGCTGACATTACAGTTAAAGGAGATGCTACCACTTTAGTTGAAGGAAATCAAACTAACACAGTAAATGGAAAT
CTTTCTTGGAAAGTTGCTGGGACAGTTGATTGGGACGTTGGTGGTGATTGGACAGAAAAATGGCATCTATGAGTTCTATTTCATCTGGTCAATACA
CAATTGATGGATCGAGGATTGACATTGGCTAATATACTTCCAATGAGCGCTGATTTAGGAGAATCCATGGAAGGTTCTTCATCGACGTCACCTTTA
CCGCTCAATTAGAACACAGGTGAACGTTAGTATCTATAAATATAACTAGTTACGAAGAAACTCCTGGGGTTTTAGTAGAAGAAAATCGCTTATACGG
AACATATGAATCTGTGTTTGGATTTGGAAATGACGCGTTGAAATATCGTTTAGGCGATGAATTTAAAACTGCTGCTTCATGGAAGAAACTTCCTACT
GATTCTGATACTCAGTTGTATTTATGGAAAGCTCCTCAAAACCTCCAGAAGACATTCACTTACGAAGTAACATTAATATATGACTACCAAGAACAAA
GTGAATCTGGAGGTTCTGGCAGTAATTCTAGGTCATCTTCTGATACTACTGAACCGACAGATCCTCCTGCTCCAGTAAGAAAAACTCTCGTTAAAAA
TTATACTAAAACTATAGTTGGAAATTGGAGTCGTTGGGCTAATAAATTAAGAAGCTATGTGTATGAGAGGTCATAGATGTCAGGATTAAGTTATGAT
AAGTGTGTTACTGCCGGCCATGAACGTAGGCATGGCCTTCCAACAGTTGTGAATGCTACACAAAGTAAAGTATTCACTGCAGGAATTGCTGTTCTCGTAGCAG
GTGATCCAATTACAGAACATACAGAAATTAAAAAGCCATATGAAACACATGGCGAGTGACACAACCTAGAACTTCTAAGGTATATGTCACTGGAAA
GAAAGCGGTTCAAATGGCTGATCCAATATCATGCGGTGATACTGTGGCTCAGGGCATCATCTAAAGTATTCATTAAATAGGATTTAAAATGGCAAATA
CCCCTGTAAATTATCAATTAACAAGAACAGCAAATGCTATTCCCGAGATATTCGTCGGGGTACATTTGCTGAAATAAAACAAAACCTCATTGAATG
GCTTAATGGCCAAAATGAATTTTTGGATTATGATTTTGAAGGCTCAAGATTAAACGTTCTGTGCGACCTTTTGGCTTATAATACGCTGTACATTCAA
CAGTTTGGTAATGCTGCTGTGTATGAAAGCTTTATGCGTACTGCTAACTTACGAAGTTCAGTTGTTCAAGCTGCACAAGATAACGGATATTTACCTA
CTTCAAAATCCGCTGCGCAGACCGAAATTATGTTAACATGCACCGACGCATTGAATAGGAATTACATTACTATTCCTGCGGAACTCGCTTTTTAGC
```

Figure 12(S)

```
ATATGCAAAAGATACTTCTGTTAATCCATATAACTTCGTTTCTACCGAAGACGTTATTGCTATTCGTGATAAAAATAACCAATATTTTCCGCGTTTA
AAATTGGCCCAGGGACGTATAGTAAGAACTGAAATCATTTATGATAAATTAACACCTATTATCATTTATGATAAAAATATTGATAGAAACCAGGTTA
AATTATACGTTGATGGAGCAGAATGGATTAACTGGACAAGAAAGTCAATGGTTCATGCTGGTTCTACATCGACAATTTACTACATGCGTGAAACTAT
TGATGGAAATACCGAGTTTTATTTTGGTGAAGGTGAGATTTCTGTTAATGCGGCAGAAGGAGCATTGACCGCTAATTATATTGGAGGTCTTAAACCT
ACTCAGAACTCTACGATTGTTATTGAATACATCAGTACTAACGGTGCAGATGCGAACGGCGCAGTCGGATTTTCATATGCAGATACATTAACAAATA
TAACTGTCATCAACATTAATGAAAATCCAAACGATGACCCAGATTTTGTTGGGGCAGATGGCGGCGGCGATCCAGAAGATATTGAACGTATTCGCGA
ATTGGGTACTATTAAACGCGAAACCCAGCAACGCTGCGTAACTGCGACTGACTATGATACATTCGTTTCAGAGAGATTTGGTTCTATTATTCAAGCA
GTTCAGACGTTCACTGATTCTACTAAACCTGGTTATGCATTTATTGCTGCTAAACCTAAATCAGGACTATATTTAACTACTGTACAGCGCGAAGATA
TTAAAAATTATCTCAAAGACTATAATTTAGCTCCTATTACGCCATCAATTATTTCTCCTAATTACCTTTTTATTAAGACTAATTTAAAAGTCACATA
TGCTTTAAATAAGCTGCAAGAATCCGAACAGTGGCTCGAAGGTCAAATAATTGATAAAATTGATCGTTATTATACCGAAGATGTAGAAATTTTTAAC
TCATCTTTCGCTAAATCTAAGATGTTGACATATGTAGATGATGCAGATCATTCTATCATTGGCTCATCCGCGACAATTCAAATTGTTCGTGAAGTAC
AAAACTTCTATAAAACGCCTGAAGCAGGTATTAAATACAATAATCAAATAAAAGACCGTTCTATGGAATCTAATACGTTTTCATTTAATTCTGGACG
AAAGGTTGTAAATCCTGATACTGGTTTAGAAGAAGATGTATTATATGACGTTCGCATAGTATCAACAGACCGAAATTCTAAAGGAATTGGTAAAGTT
ATTATTGGTCCATTTGCTTCTGGCGATGTTACAGAAAATAAAAACATTCGTCCATATACAGGAAACGATTTTAACAAATTAGCAAATTCTGATGGAC
GCGACAAATACTATGTTATCGGTGAAATAAATTATCCAGCTGATGTGATTTATTGGAATATCGCTAAAATTAATTTAACATCTGAAAAATTTGAAGT
TCAGACCATTGAATTATATTCTGACCCAACCGATGATGTTATCTTTACTCGCGATGGTTCACTGATTGTATTTGAAAATGACTTACGTCCACAATAC
TTAACTATCGATTTGGAGCCTATATCACAATGACAGTAAAAGCACCTTCAGTCACTAGTCTCAGAATTTCCAAGTTATCCGCAAATCAGGTGCAAGT
ACGCTGGGATGACGTTGGTGCTAATTTCTACTATTTTGTAGAAATCGCTGAGACAAAGACAGACTCGGGGGAAAATCTCCCGAGTAATCAATATAGA
TGGATTAACTTAGGATATACTGCAAATAACAGCTTCTTTTTTGACGATGCTGACCCATTGACATCATACATTATTAGAGTAGCTACAGCGTGCACAAG
ATTTTGAGCAGTCTGATTGGATTTATACCGAAGAGTTTGAAACTTTTGCTACAAATGCTTATACATTTCAAAACATGATTGAAATGCAATTAGCTAA
TAAATTCATTCAGGAAAATTTACTCTTAATAATTCTGACTATGTTAATTTTAATAATGACACTATAATGGCTGCATTGATGAATGAATCATTCCAA
TTCAGCCCATCATATGCTGATGTTTCATCAATAAGTAATTTTATTATTGGTGAAAATGAGTATCATGAAATACAAGGTTCTATTCAGCAAGTATGTA
AGGATATTAATCGAGTTTATTTGATGGAATCAGAAGGGATTCTATATCTTTTTGAGCGTTATCAACCTGTAGTTAAAGTATCCAATGATAAAGGTCA
AACCTGGAAAGCTGTAAAGCTCTTCAATGACCGTGTAGGATATCCTTTATCTAAGACTGTATATTACCAATCTGCGAGCACAACATATGTTCTAGGA
TACGACAAGATTTTCTATGGCCGCAAATCTACTGATGTTAGATGGTCAGCTGATGATGTCAGATTTAGTTCGCAGGACATAACATTCGCTAAACTTG
GTGATCAACTTCATTTGGGATTTGATGTTGAAATCTTTGGTACTTATGCTACATTACCTGCAAACGTGTATCGTATAGCTGAAGCTATTACTTGCAC
CGATGATTACATTTACGTTGTCGCCAGAGACAAAGTTAGATACATAAAAACGAGTAATGCACCTATAGATTCTGATCCATTATCTCCAACATATTCG
GAAAGGCTATTTGAACCTGATCAATGACTATAACTGGAAATCCTAAAGCAGTATGCTATAAAATGGATTCTATTGGTGATAAAGTTTTTGCTCTTA
TTATCGGTGAAGTTGAAACATTAAATGCTAATCCTAGAACGTCAAAAATAATTGATTCTACTGATAAAGGAATATATGTTTTAAATCATGACACAAA
AACGTGGAAAAGAGTTTTTGGCAACACTGAAGAAGAAAGAAGACGTATTCAACCTGGGTATGCGAATATGTCAACTGATGGTAAATTAGTTTCTCTA
TCTTCGAGTAATTTTAAATTTTTAAATGATAACGTTGTTAATGACCCTGAAACTGTAGCAAAATATCAGTTAATCGGTGCCGTTAAATATGAATTTC
CTCGTGAATGGTTAGCTGATAAGCATTATCATATGATGGCATTTATAGCAGATGAAAAGTCTGATTGGGAAACTTTTACGCCTCAGCCAATGAAATA
CTACGCAGAACCGTTCTTTAATTGGTCTAAAAAATCTAACACACGCTGTTGGATAAACAACTCTAATAGAGCTGTAGTAGTTTATGCTGATTTAAAA
TACAC
```

Figure 13(A)

```
K2 contig 1, site B Nanoluc insertion only (SEQ ID NO: 24)

ATGTGTTTCCAGAAAATTTCTTCTTTAACTACATCATCTTTACGAGTATCGCCTTGTTTGCGTTGGATATGCAAATTAAACGGAATATCGTTTTGTA
AAAGCCACTCACGTGTCATAACATAATATTTTAACTTAGCATTTTCGGTGCCAGATTCACGTCCGCTTACAGTAATAATCTCATAACCCGAGTGATG
AAGCATCTTCAGATATTGTACAACCATTTCGTTGGTGTATCGGTTGATAATTTATCTAATTCGTATGGGCCACGAGATGTATGAATAGCTAGTGTT
CCATCAAGGTCAAAGATTGCAGCTTTTGGTTTACCAGGAGTCCCTTTGTATACCGGAAGACCGAGATACTCTCGCATACTTTTATACATTGAGCGTA
AAACATCAATTGGTACTGCTTTAGTTCCACGTTTTGAGTTACGTTTAACCAATTCAGTCCAAGGAACATCAAACACTTTATATTCAACTTTCCATCC
GTATTCTTTGGCAAAAGTTTCCCATGCTAGGCGACGTTCAGGATTCAAGTTAGTGTCTGAAATAATTACTCCCTTGACAGAATCACCGCCGTACAGA
ATACTCTTCGCGGTATCAAACTGCATACCGGTCACAATGCCTTCTTTCTTTTTGGTATACTTGTACTCGTCACGTTCTTCATGACCCATGATGGATT
GACGATAATCATCACGATTGATATTATAAAATCCAGGATTTTTAGCAATAAATTCACGAGCCCAAGTGCTCTTACCTGAACCAGGACAGCCAATAGT
TAAAATAATCTTTTTCATCATTTAATTCCTAAGAAAACTTCAAGAATACGAATATTATGCTCACGTCGCTCTTTATACACTTCAGCTGTTGATTGAT
TCACTGATTTGCTCTGAACATTAGATGAAATAAATTTTATCATGTGATTTTTAAGCTGATACATATCAAGTCCACGAGCTTTTGCTTCTTTTCGTAG
AGCTTTACCAGCGTCATCTAAAGCTTTCGTAGGGTCTTCATCATTTAATACTATTCCACGATCCAAATCCATGTATACTGCACCATGACATGCATCA
ATGTAAGGTCTGAGCATTCAATATAACGTTCTAACAGAGTTTTCATTTATTTTTCTCAACTAATGATTGAATATAATCATGCAGGTCTTTAGATGC
TTTACCCCACTTATTTTGATATTCATTTTTGAGATTAGCACGGGATTGAGCTAATAAAACATCATTAGTTGGAGGTAAAGATTCTAACCGCTGAATC
TGGCGTCCATAAATCATTGCAGCCATCTCGGATTCATAAATCAATCCTTTGAGATGTTCAAATTGATGCCATGAAATCATTTACATTTATCCTCTTT
TAACTCTTGACGATAATAACATATCATAGTTTTTTGGTCATGTACATATCGTTTTACATCATTAAGCCAAATACGAAATTCCTGGGAATCTTCAAAT
GACATACCGACCCAAGCTTTACCATCAATAACTTTAACTTGCCAAGATAGTTTAGCTTCATCATATGACTTTATCTGTACAGGCCAATTAGGATGAA
CTGTTTCTTTCTTTACTTCTAGAGGCTTTGTCGAACAACCAACTAGAAGACCAATAGATAATATTACTGCTGATAGTTTAATCATTTAGAAAGGTCC
TGGATGTCTTCTGCGAACTTGTTGAAGGAGTTGTTGATTTGTTTTTCAACCAATCCTGGCTTACGAGCCACCACATCCGCCTTCTTTGCATCTTTGC
GCAGTTTTTCATTTTCACGCTCAATAGCAGCAATCGCCTCCACGATTTTATTATTCATCGCATCAATATAATTATACTGAATTCGCAAATTATTTAA
TGCTAAGGCGTTTTCATTGGCCGTTTTTGTAATTTCTACAACAGACGTTTCTAATCTTTCAATTTTATTTTTAAAATTAAAGAAGTTCCGCCTAAT
GCAATTACAATTAATAGCAAACCTGCTGTCGTATTACTTAATTGCATAAAGTTTTAATAACCTCTATAATATCGTCTTGAGAAAGACCGTTAATTAA
AATATGATGTTCAGCCGGAGATTTAGAAATTTTAAAGCACGCCGCAACATCTTCTGCCATATCCGATGCGCTACGATTTGGATTACTAATTCCAAGA
CGATGTTTTCCCGTTAAAGGATTAACGATGATATAGCATTTACAGTTGTTAATATGAACATTAGGTTGAGTCTGATTAATAAACACTTCACAATCAT
ACTTAGCGAGTTGATTTTCTAAAAAGACTTTCATCTCCTCAACCGCATCAGGAAGCATATCACGGGCTTGCTCAAGACGACGATTTCGATATTCTTT
AATGGTCGTTTTCCGCTTGACTTGCTTAGCTAAATCTTTCTTAAGATCGGTGATATATCCAACTCGACGATTTCCTTTAAATACAGAAATCCCATCT
GTAGTATCACCGTATGCTTCAACGACCATTTCAGTAGTAATAAGCTGTAAATCCATCATAAAGTCCTCATGTTATGTCAGTAAGTCTACTATAACAC
AACACGAGGGGTTTGTAAACAGCTTAGTATCCTTCTGGGATAAATTTTTTATAATTTTTCAAAAAATTCTGTTCGATTTCACACATGACCTTTTCTT
GACTATCGTACCCCTGGTATAAGCTCATGATGATACCGAACAGATGTTCCATTCCAGCACCTTTAGCAACGCCTTGCGCTTCCATTGCATAAGTCTT
TCTATCCTTACCACAATGTTTATTGTGACAGTCAAGAACTAAAAACAGAGCTCGGTCTAAGTACTTCAGATAAGTCGTTTCAAACGCCTCAATTTTT
CTGTATGAATATTCATCATCAGCGTACATTGCTTTAAGATCATCTGATGCACCATCAATAATAGTCTTAAACAGTTTTTCTGGATTGTCTAATGAGC
TTTTTGTACTATGAAGAGACACGTACCAGTCAGACTTAATTTTAAAATGAGAACCATCTTTCATCACAGCAACATAGCCTTCGATGTTTTCCGCATT
TTTAGCTTCTTCTACCCATTTAGGGCTATCGATTTCGTATCGTTCAACTAGATATGGACGAAGAACAGCATCTTTATAAATGTCATCATATGAAATG
TATTCACCTGTTTCATTTTCACGAATATTCAATAAAATGATTTTCACCTCTTGATAAGCAAGAACGATTCTATTAGTTGGAGCGACGAATTCGAAGT
TAGCAGTAAATCCATCTTCAGCTAATTCTTTAAGTCTATCACGCAACCGATGGTGATTAATATTCATCAAAATACCATTAGCCATTAAAGCCTGTTC
GGATTTGATTGAACCCTTTGATTTGAACAGAATTTCATCACCATCTAAATAAGTTGATACCAAAGACCCATCTTCCTTTGTCAGAATGTAATCAACA
TCATTTAAATCGATATTCATCGTGAATGGATTTTCATTTAAGTTAAAAAACTTTTCCATAGGACGAGAAGCAATTCTTACTGGTTTTTCTCCATCCA
TTTCAAACATGATTCCACGACATTCCAATGCATCTGGAAGTAACCAATCAGAATAAGATGCATAATTATATGAGAAAATTCTGTAAGTTCTTCCAGA
TGCACTTACATCATCTGAGTAAAAAAACTTACGCTGTGAATCCTTACATAGTTCCATTAAATTGTTAAAAAGTTCTTGCATTGTGTATCCTCTTTTG
TGTTTTGAATATAGTACCAACTCCATGTGGAAGCATCATTTTTCTTAGTGTTGAATATTCCAAGGCGGGTTAAACAGCTTAATGAATAGTGGTTCC
TCTAGGTCAATCGTCGCGATTGTCATTGTACCTAACTCATTTGTCATAGAAAGATTAAAACATTGGCGGGCGTAAAATTCAACTTTGCTTCCTTCCT
TTAGCGCAGAATGAATTAATGCAGATTTAGTAGAATCAGACGTTTTGTCTTTACGATTAATAGCAGTTCTATAATAGTTTATTCTTTTACGTAAATT
TTTAGTTTTTCCAATATAAACAAGCTCATCATTTATAGCAATAGCATAAATTACGTTATACTTGTTTGGAATAGATAATTGTTTTATACTTCCGTTG
TCGTCTAATTCTAGCTCAGTATATTTAATAAATGAATATTCTGTTGCAATTTCTTTCATAATAAAATGGGCCTTGCGGCCCACTCCTTAAAAGTATT
TTTTAAAACTCATCATAACTTTATCATCAACATCATTATCAATCTGTGCAACAAGATAAGATGACAGTTCTACTTCTTGCGGCGCGGATTGAACATT
ATCAGAATTAAGGTATTCACGAATCCAAGGATATGGATGTTTAACCGGAGCACCGGTAATTGGGCATGGAAGACCACACTGTTTCATCAGAGATACA
GTTAAGTAATCAATAAAGCTCCACATGCTATTTGTATTTAATCCAGGAACATCGCCATCTTTAAATAAATGAACTGCCCAATCTTTTTCTTGGCGGT
TAACTTCCATGAAAATATCAACTGCTTCTTGNTCNCACTCTTTGGCAATTTTAACCCATTCATCACCATCAGTGCCAAGTTGAAGTTGACGAATAAT
ATATTGTGTACCTTTAAGGTGGAGTTGCTCATCACGCGCAATAAATTTCATAATCTTCGCGTTACCTTCCATGATTTCCATATTCTTATGGAAGTTG
AAAGTACATGCAAAAGATACATAAAAACGGATAGCTTCCAGGGCATTGATAACGTGCAAGCAGAGATAAAGCGACTTCATCAGGTCACGTTTACAAC
CTGCAACATGGTCAATAGCGTCTTGGACAAGTTCTTCATCATGCTCTGTTGCCAGGTAGAATTCTACGTCAGCTTTAGCGTTTTCCCATTCACGAGT
CTTTACCAGAACATCATCATAATAACGACCAATCGATTCAGCACGTTTCATGATTGCATCATCAAGAATAATCTCATCAAATACCTTGGCAGGGTCA
TTGAACAGGTTACGCATGATGTGAGTATAAGAACGTGAGTGAATAGTTTCACTGAATGTCCAAGTTGCAGTCCATGTATCTAATGACGGGTCAGAA
TCAATGGCATCAGTACTGCTGCAGGAGCACGTCCTTGAATACTATCTAACAATGACTGATATTTCAGGTTGTTAGTAAAAATATTTTGCTGATACTG
AGGAAGCTTATTAAACTGTGCAGCATCCATCATCAAGTTTACTTCTTCAGGACGCCAGAAAAATGATAATTGCTTTTCGGTTAAATCTTCAAAAACT
TTATGACGTTGAATATCATAACGTGCAATACGACCTGAACCAAAAAACATAGGTTCTTTTAAAACATCAACTGGATTTGTATTAAAAACTGTGC
TCATAAATTTTCCACTTAGTTAATAGTTGGTGACTCGTCCATGAGTCAAATTATATCATAATTTACAGGATGAACAATCTTCAGCTTTTGGAGTTTC
TATTTCATAATCATCAGTACCAGAACCGTCACGGGTATTATGATAATAGAAATTTTTCCGCCAAAATACCAGAAATACAAAGGTCATCAATCATT
ATTGACATTGGAACCTTGCCTTTAGGGAAGATTTGGGGGTCATAGTATGTATTCGCTGAAGCTGATTGACATACCCATTTCAGCATAATAGCTACCT
GCGTAAGATAAGGTTTATTACCTTTCTTAGCTAATTTCCATGTATAATCATATAAGTCTATGTTATGTTCAATATTGGGCACGACTTGATTAAAGGA
ACCCTCTTTTGATTCTTTAACAGAGACTGGTCCACGTGGAGGCTCGATACCGTTTGTACTGTTAGAAACTTGGGAAGATGACTCACATGGCATAAGT
GCTGATAGTGTGCTATTACGGATGCCAAAGAGCTTAAGGTCTTCCCGCAGCGACGACCAGTCACAAACGTATTTTGGAGCTGCGATTTGGTCAATCT
```

Figure 13(B)

```
TTTTATTGTACCAGTCGATAGGTAATTCGCCTCGAGACCAACGAGTGTCTGAATAATATTCACAAGGTCCTTTTTCTTTGGCGAGCTTAATGGATGC
TTTAATGAGTCCATACTGTAATCTCTCAAATAGTTCATGTGTTAAATCGTTAGCATCTTCATAAGAAGCAAAGTTACTTGCCAACCAAGCTGCATAG
TTAGTAACACCTACGCCGAGGTTACGACGCTTTTTAGCTTTTTCTGCTTCAGGAACTGGATATCCTTGGTAATCCAAAAGATTATCAAGAGCACGAA
CCTGGACTTCTGCCAATTCATTAATTTTATCTTGGTCTTGCCAGTCAAAATTATCCAGTACGAATGCAGAGAGAGTACACAATCCAATTTCAGCATC
AGGACTATTCACATCATTTGTTGGAATAGCAATTTCACAGCACAAGTTACTCTGACGAATAGATGCCTTTTCACGAATAAACGGAGTATAGTTATTC
GTATTATCAATGAACTGCACATAAATCCTTGCTGTTCCTGAACGTTCAGTCATGAGCAATTCAAATAGTTCACGGGCTTTAATACGCTTTTTACGAA
TATTAGGGTCTTTTTCTGCTGCTTCGTATAATTCACGGAAACGGTCTTGGTCTTTAAAATAAGAATAATACAGCTCTCCACCCATTTCATGCGGACT
GAACAAAGTAATGTAATCGTTCTTTCCGAATCGTTCCATCATCAAATCATTCAGCTGAACACCATAATCCATATGACGAATGCGGTTTTCTTCTACG
CCTTTGTTATTTTTCAAAACGAGAAGATTTTCAACTTCCAAATGCCAAATAGGATAATAAGCAGTAGCAGCGCCGCCACGAATTCCACCCTGTGAGC
ATGATTTAACAGCAGTCTGAAAATGTTTCCAAAAAGGAATAACACCAGTATGGCGTACTTCACCCATGCCAATCTTAGAACCTTCAGCACGAATCAT
ACCAACGTTAATACCAATTCCAGCGCGTTTAGAGATATATTCAACAATTGAAGCGGAAGCCTTATTGATAGACTTCAATGAATCTCCTGCCTCAATA
ACAACGCATGAACTGAACTGTCGAGTCGGAGTACGGCAACCAGCCATAATAGGAGTTGGCAGTGAAATCTGTCGAGTAGATACTGCTTCATAAAAAC
GAATAACATGTTTTAATCTATCAACAGGTTCATCTTGATGCAATGCCATTCCAATAGTCATAAATGCAAACTGTGGAGTTTCATAAATTTGACCAGT
GGTTTTATCTTTAACTAGATATTTTTCTTTTAATTGCATCGCCCGGAATAAGTAAATTCCATATCCCGTTCGTGCTTAATTTTTGATTCTAAAAAT
GTAATTTCTTCTGCTGAATATTTTGACAATAATTCGGGTCATATTTACCTTCATTTACACAGTAAGAAATATGGTCAATAAATGAACGTGGTTCAT
ATTGCCCGTAAACATGCTTACGAAGAGCAAACATTAAACAGCGTGCAGCTACGTATTGATAATCAGGCTCTTCAACTGAAATAGAATTCGCAGCAGC
CTTAATGACAATAGTCTGAATGTCATCAGTGGTCATTCCATCACGGAGATATGATTTAATATTTTCATATAATTCATAAGGATCTACAGATGTTCCT
TCAGCTGCCCAAGATAAAACTTTAATAATTTTTTTGTGGATCAAAGCTCTGAGAAACACCACTACTTTTGATAACATTAATTAATTGCATAAGTCCTC
AACTTGAAAATCGTCTTTAAACAATCGGTTAACTATATGAGCTATTATATCACCATGCACACGGCTTTGGTTTACATGTGCATCCTAGCCTCATTCCA
CGTAAAGGCTCTAAATGTGCTTTAGTTATTTCTCCGGATTTAATTCGACGTATAAAATCTTTTTTGAATAATTCAATGGCAGCCTCCCGGCTGCCAG
CATCTTTACCGACGTAATTTCCCCAAAATGTACCACGGTGAATATTAACATCAAAGTCGGATTTGTATTTATTCACTACCCGACATAGACGGCCCGC
GCGGTGATAATTCGGCATATTGTTTTTCCGTTAAAACAGTAATATCGTAGTAACAGTCAGAAGAAGTTTTAACTGTGGAAATTTTATTATCAAAATA
CTCACGAGTCATTTTATGAGTATAATATTTTTTGCCATAAATGATAATAGGCTGATTTGGTCCTGGAACTTCTAGCTCACTTGGATTAGGAAGTGTA
AAAAGAACGACACCAGAAGTATCTTTAAATCGTAAAATCATATATCCTCGCAATTAAATTAAAATTATACCGCCATTTTTCCTTTCAAGACACCGTG
GGACTGATAATCTTTGAGAACGAAATCTTTAGGCCTGAGTTTAAGAATATATTCCAATTGTTCTTTAGTAGAAAGATAACGGAATTTATAAGGCAAT
CCGCCTATTACCAGTTCACAAAGCTCTTTAGGTTCACGACGTAAAATTTCTTTACATTGTTCTACGTGATTCATATAGATATGAGTATTACCGCCAG
AAAATATCAAATCTCCAGGAATAAGATTACACATCTTAGCTACAATATGAACTAACGTAGCATATGATGCAATATTAAATGGAAGCATTATGTTCAG
ATAAGGTCGTTAATCTTACCCCGGAATTATATCCAGCTGCATGTCACCATGCAGATCAGACTATATCTCCAACTTGTTAAAGCAAGTTGTCTATCGT
TTCGAGTCACTTGACCCTACTCCCCAAAGGGATAGTCGTTAGGCATTTATGTAGAACCAATTCCATTTATCAGATTTTACACGATAAGTAACTAATC
CAGACAGAAATTTTAAAATGTCTAGCTGCATCTGCTGCACAATCAAAAATAACCCCATCACATGAAATCTTTTTAATATTACTAGGCTTTTACCTTT
CATCTTTTCTGATATTTTAGATTTAGTTATGTCTGAATGCTTATGATTAAAGAATGAATTATTTTCACCTGAACGATTTCTGCATTTACTACAAGTA
TAAGCAGAAGTTTGTATGCGAACACCGCACTTACAAAACTTATGGGTTTCTGGATTCCAACGCCCGTTTTTACTTCCGGGTTTACTGTAAAGAGCTT
TCCGACCATCAGGTCCAAGTTTAAGCATCTTAGCTTTAACAGTTTCAGAACGTTTCTTAATAATTTCTTCTTTTAATGGATGCGTAGAACATGTATC
ACCAAACGTTGCGTCAGCAATATTGTATCCATTAATTTTAGAATTAAGCTCTTTAATCCAAAAATTTTCTCGTTCAATAATCAAATCTTTCTCATAT
GGAATTTCTTCCAAAATAGAACATTCAAACACATTACCATGTTTGTTAAAAGACCTCTGAAGCTTTATAGAAGAATGGCATCCTTTTTCTAAATCTT
TAAAATGCCTCTTCCATCTCTTTTCAAAATCTTTAGCACTTCCTACATATACTTTATTGTTTAAAGTATTTTTAATCTGATAAATTCCGCTTTTCAT
AAATACCTCTTTAAATATAGAAGTATTTATTAAAGGGCAGTCCTACAATTTAGCACGGGATTGTCTACTAGAGAGGTTCCCCGTTTAGATAGATTAC
AAGTATAAGTCACCTTATACTCAGGCCTCAATTAACCCAAGAAAACATCTACTGATCGTTGATACCACTGCAAATCCAAATAGCCATTACGCACATT
AACTGATAGAACATATGACAAGGCGGTAATGCCATATATTTAAGTTCAGCTGGATTCCATGCTGAAACAATTTGACGCTATCATTTGGCAGTTTT
TTAATACGATCAATAACTTCTATAATTTGGTCTACACCACCAAAATCACGCCACTGTTTTCCATAAATTGGACCAAGTTCACCGCTATGGTATCCTA
AATCTTTTGCTTGATTTTCGTAATTTTCATCCCAAACTGTTTTGCCTTGGATTAACGAATCATGTTGAATAATCGCAAATCATTGACATTTGTGCT
TCCCGATAAAAACCATATTAGCTCAGCAATGCAAGCTTTCCAGGCGAGCTTCTTAGTTGTTACTGCAGGAAAACCTTTAGTTAAATCCCAGCGTAAT
TTAGTACCGAACAAAGCAATTGTTCCTGTGCCTGTTCGGTCATCGGTTTTGTAGCCATTTTCCAGGATATCTTTAATTAAAAATTGGTATTGTTTCA
TTAGTTCATCCAAGAATATGTAGAAGGATATTTGGCAAAGTTAGGCTTATATCCTAATTTAACCATTTGTTTTGCTTTGCGAGTAAATCCTAAAGAA
CGCTCACCTTTAAGATATTGTTTGGTGTCATAGGCCCTTGATGCATCTGCCTACAAATAAAAAGGGCCATAGCATTAGGAACATCCTTAACTTTTA
ATTTATTGCTCATTTATATACTGATTCCGTAAGGGTTGTTACTTCATCTATTTTATACCAATGCGTTTCAACCATTTCACGCTTGCTTATATCATCA
AGAAAACTTGCGTCTAATTGAACCGTTGAATTAACACGATGCCTTTTAACGATGCGAGAAACAACTACTTCATCTGCATAAGGTAACGCAGCATATA
ACAGAGCAGGCCCGCCAATTACACTTACTTTAGAATTCTGGTCAAGCATAGTCTCGAATGGTACATTAGGGCTTGACACTTGAATTTCGCCGCCAGA
AATGTAAGTTATATATTGCTCCCAAGTAATAATAGAAATGTGCTAATCGCCGTCTTTAGTTACAGGATAATCACGCTCAAGGTCACACACCACAATA
TGGCTACGACCGGGAAGTAATGTAGATAATGACTGGAACGTTTTAGCACCCATAATCATAATTGTACCTTCGGTACGAGCTTTAAAATTCTGGAGGT
CCTTTTTAATTCGTCCCCATGGTAAACCATCACCTAAACCGAATGCTAATTCATTAAAGCCTTCGACCGTTTTAGTTGGAGAATAAGCGAATACCAA
TTTAATCATTACGCAAAACCCCTTCAATAAACCATTCAGTGGCTTTATTAGCATCAAAGAATAATTCTTCATACGTCTTTTCTTTGTTTTCAAAAA
CTGTCACACAAACACGTTGACATTCTCCACAGTATTCTTCTGACATGCTCAAAGCGTCAGAAAACATTTCGTTAAATTCACTTAAATCAGGATTATG
CAATGCGTTAAAAATTGCATAATCGAATTCATCATTCATAAATTCAAATACAAAAATCATATTACCTCCCACTGAAAGGGGCCAGAAGCAAATCCGC
TATCTTTAATCATTTTAACTAAAGTTACCATTCCTTTGTTAACTGCTTGTGCGATTTCATCAAAAACTTCATCGCTATCATCATAAAGGTCATTAAA
AAGTTCTAACACGTTCTTCTGAACTTTTAATTTATGACCAACAATCTCGCCTACAGTAAATTCGTTTCCGCCGATTCCAGTGTAAAACGTAATTACA
CCAGTTAACAGACTTTCGCGAGAATCTAGGTCATGTGATAAATTAATATAAGCCATCCCGGGTGCAGTTTTAAGTTGGCAACGAATTCTTACTTGGG
TAATTCCGGTTACATGAATGACGGACATATTATTTTCCTCAAATAGACTTTTTCACAATTTTCCAATCAGCTTTAAACTGATCAACGTCAGAATGAT
AAATCCAGAATCCTGCGCTTTCTCCATCCTCATAAAGAGGGCATCTATCACATTCATCTTCCCATCCCATATCACGCAAAGATGTTCAGCTTTTTC
AACAAGCCCAGAATCTTTACCGATGATATTAAAATACCATTTACCTTTAACTTCTGAATCTTTGATGCTCTGGCGTTGTAATCTCATTTTATTCTCC
TTAGCAAGCTTTAATCAAAAGATATAAACAGACCAACATAACTGCTGCCATAATATAAGGTGCGAACATTTTCTTTTCTCCATTAGTTTTGATAGGG
TAATAGTATTATCACACTACTACCCTGTTGTAAACTACTTTTTGAAAGTTTTTCGCAAAAGTTCAATGATTTCATCTACATTATTTTCGTCAACAAT
GCAGTGAATTTTTGTTACGCCAGAAACCTTGTCTTTAACTTCATCCTCTTCAGAAGTAGGTTCTTTATATTCGTGGAAACAATGAAATTCGTCTTCA
CAAACGTTAAAGTAAAAATGCTTTCCATTTGCGCATTCAATGTGTTTTATTACTCTAAATCCATCAACAAAGAAAGCTTCTTTAACTTCAAACCATC
CACCATTTTCTTGAATAATTTTAACTATTGATGAATTAGAACGTGGGCGATAATTAATAAATGTATCAATAAGTCTTGGAACAAGCTCATACTTTTT
GCCAATATACATTACGTTTTCCTCATTTTAACGGGGCTTGTAATAGCCCCTTGATAATTATTGTTCAATCAATCCCATGTAAAATTCTGCGTCTTCA
```

Figure 13(C)

```
GAATCCATACCATCACAATATTCATTAGCCATAAAGCGGGTGAGGTCTTCAAGAGGACCTTCAATGACAATAGAAAAATTGCAATAATTGGGATCAT
CGTGAATACTTGTGATACTAAGTTCAGGATAACGATTACGAATAATTTCTTCAATATATTCAAAATCAACGATGTCAATATCAACTTTAGCCATATT
ATTTTCCTCTTTAATTATCAGCAGTATTGCCGATAGTTGTATAGTACCATGGAAGGACAAGGATGTAAACCGTTTTATGAAAAATTTTTGAAATAAA
AAAGGGGACCTCTAGGGTCCCCAATTAATTAGTAATATAATCTATTAAAGGTCATTCAAAAGGTCATCCAGGTCNGTGTCATCAGCACTAGATGAAC
TGCCAGAGCTTGAGCTCATAAAATCATCTTCAGTTTTTGTATTGAAGTCATCAACATTGAATGCATCCAAATCATCAGCAACTTTATCAGCTTTCTT
AGCAGCAGTTGCAGCGGCACCGCCCATCACAGCAGTTCCCATAACTTGACCGAATTTAGTGCTCAGTTCTTCAAATGATTTGAATTTATCTTTAGAA
GTCATTTCAGAAAGGTCAACCATTTGTTCGAACAGTTCTTTCTGGAAAGATTCATCGTCAATGTTTGGAATCGCAGATTGATTCAGGAATTTAGATT
CGTCGTAGTTACTAAATCCAGAAACCTGTTTAACTTTCAGTACAAAGTTAGCACCTTCCCACGGACAAGTTACATCAACCGGAGTTTCACCCATTTC
AACATCAACCGCAATCATCGCGTTGATTTTATCCCAGATTTTCTTACCGAAACGATATTTAAATACTTTACCTTCATTTTCTGGAGCAGCTGGGTCT
TTTACTACAAGAATGTTAGCCCAGTAAGAAGTTTTACGTTTAACAAGACTGTACTCTTTATTGTCAGTGTTGTACAGATCATTTTTACTGATATACT
GACATACTGGACAAGAATCGTAATCACCGTAGGTAGATGAGCATGTTTCGATATACCATTTACCATTTTTCTTGAAACCGTGATTTACAAGAAGTGC
GAATGGTGCTTGTTCATCATTTTTAGACGGAAGAAAACGAATTACTGCTTGACCGTTACCCGCATTGTCGAGTTTCAGTTTCCACTGCCTTTATCT
TCAGAAGAAAAACCACCTTTATTTCCAGCCAGTTTAGCCATTTGTGCAGCGAGTTCAGCAGTAGATTTACGTTTAAACATTTTTATTTCCTTTTTAA
TTTAATTAACAGTTGGTGCTATGACGATGTATGACCTCATAGCTGGTCAGTGAGATAATTATAATCTATTTATAATAAGCAATTAATACTTGCAAGA
TTTCACAGTTTCAATGAAAACATTTTTAGCTTTCTGTGAATCAATATTTAAAATTTTTCTATAAGCCTTTAACTTTATAGAATAATTATTCCAGACT
AAATTATCAGTCTGTTCATCATGTTTATCAATTATATTTAAAAACGAATCAAGCAAGATAAACGTCTCAAACGAAATTATGTTCGATTGCAGAAGTT
TAAAAATATAACTTGACTGAACCTTTGGATTATATTCAAAGATTTCTTTAAAAGCAGAAACTTCAACTTTTTTACTAAAATAATAAATGTTGCGAAT
ATCTTCTTCAAACTTAAATTTAATTTGCTTTAAGCGTCCGATATATTCACGATAAAACACAAGTGCATCAGCGTCAGAGATGTCACCAATCCAAGCA
TCTTGGTTAGCAACCAGATTGCTTATAAAGATTAAAGCAAGTTCCTTTAATTTATATTTTTCTGATAACTTCTGGAAAAAATACTTATCCCTTCGCT
TTTGATAAGCGGCATCAGACACCCGCATGCACCAATTATACTTAATTACATCATACTTTCCATTCATATGTTGTTTTATCATTAAGTATAATTTATA
AACTGATTTACCATCAATATATCTTTCACCAACAGCAGGCATGCGGAGTTTAATCATAGTAGAAAATCTAATGTATTAGTTTTTTCACAACGAACAA
CAGAAGGACGTAAAAGATTTTCGTCAATAGCTTCTGACTGAATTTTTTCAATTATACCCGAAGGAATAAAATTTAGCAAATTGAGTTTCAGGAATAGA
ATTTTCTTCTAAGAATGCTGTTGTAGCTTCGAGATAACTCATTCCAAACTCTTCTACCATTTTTTCAATAATAAATCCATTTTCTTGGCGGTCAAGA
AGCTTTGCAATTTCATCCTTTCTTTCTTAATTGAAAGTTCTTTTCTGAAAGACCGGTCTCATCGACCGGACGAATATCATTTAGAGAAAACTGTG
TCATAAAGTTCAACTACCTCTTCAGTTTCAGCTTCAAACACATCACCGTTATCTTTATGATACAAAGCTAACAGACGATTAAACATCTTGCCATCAA
CACCAAGTTCATCTTTGGCACGAATTCGAATATCTTTAATCAATTCATTATAACCAGAAATTTTCAGTTTATGATCAGATGCTTCTTTAATAAATTT
AGCCAAGTCTTCGCCATGGATAGCTTCATCAAATTCAACCATTTCTTTTTTAGCCATTATTCACCTCAAAATTCATTAATGCTATTAGTTAATTTAG
AAAGACCCGCTTTTACAAAATATGAATAAATTTTGCCGCGCGGTGGTAATTTATATGAATTATAGTAATTCACAATGTTTGAAGCAATATTATCAGG
AATATAATCAAAATCAATTAGAACTAAATTTTCTTTATAACGATTATATTCAGATTCTGTGAGAAGCACCTTAGCTTGCTCACGGTCATTAGCAATA
GCTTCAACAATAGAGGTTTTCATTGAAGGAGTTCGTTCACCTTCAACTCTGGTAAACCAAAAGTCAGATCGTTCTTTAACTGAAGCAACGTTATCCT
TTTTGTCGCCTTTAAGGATTTTAGTCATACAGTCAATTTCAGCAGAACCGCTTTTAATTTTAACCCATTTCTTGTGCATCGGTGACCATTGCTTAAC
ATTTGGGTATTTGTGAAGTTGAGTAAAGTCACCATCCGACGAAATGATTAAAATCTTATGTCCTTCTAAAGAGAACTTTTTAACAAGAACAGCGATA
TGATCATCTGCTTCATACTTATCAATATCCATAACGATGTATGGCATATAAGCTTTCAATTCATCTATAACTTTATGGCTGGATTCAAAATAACCTT
CCCAGTCCCAAGTGATTCTTCTCGTGCTTTTCCGCGGTTTTTCTTATAATAATAAGCGAAATCACGGCGCCAGTATCCAGATTTCGCGTTATCAAT
ACACAGCACAATTTTAGTGTATCCAAGAGTTTTTGCTTTTTGACATTAAACTTAATTGAGTTCAATATCAAATGACGAACCATTGATAAATTAATT
TTTTCTTTATCTGGGAAGTTTACAAGAGCAGTTGAAAGCGCAATTTGACTAAAGTCAATAAAGCAAATTTCCTTCTTTATAATCTTCATCCAGCATCA
TTTCTAAATCCATATGAACCTCGTTCAATTAGTGAGATTTCTATTATATACTATCTAAATCTTAAAGTAAACAGGTATAAATACTTATTATTGAAAA
CACAATAGGAGCCCGGGAGAATGGCCGAGATTAAAAGAAAGTTCAGAGCAGAAGATGGTCTGGACGCAGGTGGTGATAAAATAATCAACGTAGCTTT
AGCTGATCGTACCGTAGGAACTGACGGTGTTAACGTTGATTACTTAATTCAAGAAAACACAGTTCAGCAATATGATCCAACTCGTGGATATTTAAAA
GATTTTGTAATCATTTATAATAATCGTTTTTGGTCAGCAACGGATAATATTCCAAAACCTGCTGGAAATTTTAATAGAATTCGTTGGAAAGCATTAC
GTACTGATGCCGTATATACAACCGTATCATCTGGACCATATCAATTAAAATCCGGAGAAGCAATTTCAGTAGATACATCAGTTGGCAATGACATTGA
GTTTACTTTACCACCTTCTCCGCTTGATGGAGAAACCGTAATAATTCAAGATATCGGTGGAAAACCTGGCATAAATCAGGTTAAAATAAATTCTTCA
AATCAGAGTATTGTCAATTTTAGAGGTGAACAGGTACGTTCAGTTTTAATGACTCATCCAAAGTCACAGATGGTATTCATTTTAATAACCGTTTGT
GGCAAATGTATATTTCTGATTATAGCAGAGAAGCTGCAATTGTTACTCCATCGACTGCATATCAAGCACAATCTAATGATTTTATCGTACGTAGATT
TACTTCTGCCGCACCGATTAATTGTTAAACTTCCAAGATTTGCCAATCATGGAGATATCATTAATTTCGTTGATTTAGATAAATTAAATCCACTTTAT
CATACAATTGTTACGACATATGATGAAACGACGTCAGTGCAAGAAGTTGGAACTCATTCCATTGAAGGCCGTACATCGATTGACGGTTCTTGATGT
TTGATGATAATGAGAAATTGTGGAGATTGTTTGACGGGGATAGTAAAGCACGTTTACGCATTATAACGACTAATTCAAACATTCGTCAAATGAAGA
AGTTATGGTATTTGGTGCGAATAATGGAACAACCCAAACAATTGAACTTCAGCTTCCGACTGATATTTCTGTTGGTGATACTGTTAAAATTTCCATG
AATTACATGAGAAAAGGACAAACAGTTAAAATCAAAGCTGCCGGTGAAGATAAAATTGCTTCTTCAGTTCAATTGCTGCAATTCCCAAAACGTTCAG
AATATCCGCCTGAAGCTGAATGGGTAACGTTCAAGAATTAGTTTTTAATGGTGAAACTAATTATGTTCCAGTTTTACAACTTGCTTTATATAGAAGA
TTCTGATGGAAAATACTGGGTTGTACAGCAAAACGTTCCAACAGTTGAAAGAGTCGATTCTTTAAATAATTCTACTAGAGCAAGATTAGGCGTAATT
GCTTTAGCTACACAAGCTCAAGCAAATGCTGATTTAGAAAATTCTCCGCAAAAAGAATTGGCAATTACTCCAGAAACGTTAGCTAATCGTACTGCTA
CTGAAACTCGCAGAGGTATTGCAAGAATAGCAACTACTGCTCAAGTAAATCAGAAACACCACATTCTCTTTTGCAGATGACCTTATCATCACTCCTAA
AAAGCTGAATGAAAGAACTGCTACAGAAACTCGTAGAGGTGTAGCTGAAATTGCTACGCAGCAGGAAACTAATACAGGTACTGATGATACTACAATC
ATCACTCCTAAAAAGCTTCAAGCTCGTCAAGGTTCCGAATCATTATCTGGTATTGTAACTTTTGTATCTACCACAGGAGCTACTCCAGCTTCTAGTC
GTGAATTAAATGGTACAAATGTTTATAATAAAAACACTAATAATTTAGTTGTTTCACCTAAAGCTTTGGATCAGTATAAAGCTACTCCAACGCAACA
AGGCGCAGTAATTTTAGCAGTTGAAAGTGAAGTAATTGCTGGACAAAGCCAAGAAGGATGGGCAAATGCGGTTGTAACGCCAGAAACGTTACATAAA
AAGACATCAACTGATGGAAGAATTGGTTTAATTGAAATTGCTACGCAAAGTGAAGTTAATACAGGAACTGATTATACTCGCGCAGTCACTCCTAAAA
CTTTAAATGACCGTAAAGCAACTGAAAGTTTAAGTGGTATAGCTGAAATTGCTACGCAAGTTGAATTCGACGCAGGCGTCGACGATACTCGTATCTC
TACACCATTAAAATTAAAACCAGATTTAATAGTACTGATCGTACTTCTGTTGTTGCTCTATCTGGATTAGTTGAATCAGGAACTCTCTGGGACCAT
TATACCCTTAATATTCTTGAAGCAAATGAGACACAGCGTGGTACACTTCGTGTAGCTACACAAGTTGAAGCTGCTGCAGGAACATTGGATAATGTTC
TAATAACTCCTAAAAAGCTTTTAGGTACTAAATCTACTGAAGCGCAAGAAGGTGTTATTAAAGTTGCAACTCAGTCTGAAACTGTGACTGGAACGTC
AGCAAATACTGCTGTATCTCCAAAAAATTTAAAATGGATTGCGCAGAGTGAACCTACTTGGGCAGCGACTACTGCGATAAGAGGGTTTGTTAAAACT
TCGTCTGGTTCAATTACATTCGTTGGTAATGATACAGCTGGTTCAACACAGCCATTAGAATCATATGAGAAAAATGGTTATGCAGTATCACCCATATG
AATTAAATCGCGTATTAGCAAATTATTTGCCATTAAAAGCAAAAGCCGTAGATAGTAATTTATTAGATGGTCTAGATTCGCTCCAGTTCATTCGTAG
GGACATTGCACAAACAGTTAATGGTTCACTAACCTTAACCCAACAAACGAATCTGGGTGCCCCTCTTGTATCATCTAGTACTGCTACATTCGGTGGA
```

Figure 13(D)

```
TCAGTTTCAGCAAATAGTACATTAACTATTTCTAATACTGGAACGGCAACTCGTCTGATTTTTGAGAAAGGACCTCAAACTGGAACAAACCCGGCTC
AAACGATGACAGTCAGAGTGTGGGGAAATCAATTTAGCGGGGAATCAGACACAACACGTTCTACCGTATTTGAAGTTAGTGATGAAACGTCTAGTCA
TTTTTATTCTCAGCGTAATAAAGCTGGAAATATAACATTTAATATCAACGGTACAGTAACACCGATAAATGTTAATGCTTCAGGAACATTGAATGCA
AATGGTGTAGCAACATTTGGTAATTCAGTCACTGCAACTGGTGAAATTATTTCTCGAAGCGCAAATGCTTTCCGTGCTATTAACGGAAATTATGGTT
TCATTGTTCGCAATGATGGATCAGTAACGAATTTTATGCTTACTACATCGGGTGATCAGACTGGTGGATTTAATGGATTACGTCCATTGTCCATTAA
TAATCAATCTGGGCAGGTCACAATTGGTGAAAGCTTGATCATTGCTAAAGGTGCTACTATAAATTCAGGTGGTTTAACTGTTAACTCGAGAATTCGT
TCTCAGGGCACTAAAACATCTGATTTATACACCCGCGCTCCAACATCTGATACTGTAGGATTCTGGTCAATCGATATTAATGATTCAGCCACTTATA
ACCAGTTCCCGGGGTATTTTAAAATGGTTGAAAAAACTAATGAAGTGACTGGACTTCCATACTTAGAACGTGGTGAAGAAGTTAAATCTCCTGGTAC
ATTGACTCAGTTTGGTAACACACTTGATTCACTTTACCAAGATTGGATTACTTATCAACGACCCCAGAAGCACGTACCACTCGGTGGACACGTACA
TGGCAGAAAACCAAAAACTCTTGGTCAAGTTTTGTTCAGGTATTTGACGGAGGTAACCCTCCTCAACCTTCAGATATAGGAGCGATCCCATCTGATA
ATGGAATAATAGGTAATCTTACTATTCGCGATTTCTTGCGAATTGGTAATGTTCGCATTATTCCTGACCCAGTGAATAAAACTGTTAAATTTGAGTG
GATTGAATAAGAGGTATTATGGAAAAATTTATGGCAGAGTTTGGACAAGGATATGTCCAAACGCCATTTTTATCGGAAAGCAATTCAGTAAGATATA
AAATAAGCATAGCGGGTTCTTGCCCGCTTTCTACTGCGGGACCATATGTTAAATTTCAGGATAATCCCGTTGGAAATCAAACATTTAGCGCAGGTCT
TCATTTAAGAGTTTTTGACCCTTCTACGGGAGCATTAGTTGATAGCAAGTCATATGCTTTTTCTGCTTCAAACAATACAACATCTGCCGCTTTTGTC
AGTTTCATGAATTCTTTGTCAAACAATAGACTTGTTGCTATATTAACTAGCGGAAAGGTTAATTTTCCTCCTGAAGTGGTATCTTGGTTAAGGGGAG
CAGGAACTTCAGTTTTTCCATCAGATTCAGTATTGTCAAGATTTGACGTGTCATATGCTGCTTTTTATACTTCTTCTAAAAGAGCTATTGCATTAGA
GCATGTTAAACTAAGTAATAGAAAAAGCACAGATGATTATCAAACTATTTTAGATGTTGTATTTGATAGTTTAGAAGACGTCGGAGCTACAGGATTT
CCTAAAAGAACATATGAAAGTGTCGAGCAATTTATGTCTGCGGTTGGAGGAACTAATAATGAAATTGCGCGATTGCCAACTTCAGCTGCTATAAGTA
AACTTTCTGACTACAATTTAATTCCTGGTGATGTTCTTTATCTTAAAGCACAACTATATGCTGATGCTGATTTACTTGATCTTGGAACTACAAATAT
ATCTATTCGTTTTTATGATGCATCAAATGGATATATTTCCTCGACCCAAGCTGAGTTTACTGGGCAAGCTGGGTCTTGGGAATTAAAAGAAGATTAT
GTAGTTGTTCCTGAAAATGCAGTAGGGATTTACGATATATGCACAAAGAACTGCCCAAGCAGGTCAAGGCGGCATGAGAAATTTAAGCTTTTCTGAAG
TATCAAGAAATGGCGGCATTTCAAAACCTGCCGAATTTGGCGTCAACGGTATTCGCGTTAATTATGTCTGCGAATCGGCTTCACCTCCAGATATAAT
GGTACTTCCTACACAAGCCTCTTCTAAAACTGGCAAAGTGTTTGGGCAAGAATTTAGAGAAGTTTAAACTGAGGGAGCCTTCGGGTTCCCTTTTTCT
TTATAAATAATATTAAAATAAAGGGGCATATAATGGCTGATTTAAAAGTAGGTTCAACTGTAGGTGGATCTGTCATTTGGCATCAAGGAAATTTTCC
ATTGAATTCAGCCGGTGACGATGTACTCTACAAATCATTTAAAATATATTCAGAATATAATAAACCACAGGCAGCTGATAACGATTTCGTTTCTAAA
GCTAATGGTGGTACTTACACCGGTCCAATTACTATTAATTACGGGGTAAATAGTTATCTTCAATTAAGTAATAATGAAACCCCCATTCGAATTCGTT
CTGGTGGCGGTACCGGTAATACTCTTGTAGTTGGCGGCTCTTCCGGCGGTATTAGTTTTAGACCTGCAGGTAGTGAAATCACTACTGGACAAATTAC
TATTACACCAGAAGGTTTGACAACATTTACCAGGGCTGTAACGGCTCCATCGATAACTGTTACATCTACTCCTTCCGCAGCATCTGATGTTACTCGT
AAAGATTATGTTGATGGAGCAATAAATACTGTTACAGCAAATGCAAACTCTAGGGTATTACGCTCTGGAGACACTATGACAGGAAATTTAACTGCGC
CAAACCTTTTTCACAGAATCCTGCATCTCAACCTTCACACGTTCCACGATTTGACCAAATCGTAATTAAGGATTCTGTTCAAGATTTCGGCTATTA
TTAAGAGGACTTATGCTACTTTAAAACAAATACAATTTAAAACAGAACAAAACTGCAGGTCAACGTCCTGCTTCAGTATTAGCCGAAGGTGAAT
TGGCTATTAATTTAAAAGATAAAACAATTTTCACAAAAGATGACTCAGGCAATGTTATAGAATTAGGTTTAAAATATGGAGGAACTATAAATGGATC
TTTAGAGGTTACAGAAAATATAACTGGAACTTTAATTGGAAATTCTAGTACAGCTACTAAAATTGCAAACACCTAGGAAAATTAATGGTATATCTTTT
GATGGATCAAAGGACATTACACTAACTCCATCTGATATAAATGTAAATAGTACAACATTTATAAAAAATAACGGCGAATTACCCGTTGATGCTAATT
TAGATACATACGGGCCCATTGAAGAATATCTTGGTGTTTGGTCGAAATCTACTTCAACAAATGCGCAACCAGCAAATAAATTCCCAGAAGAAAATGC
CGTAGGTGTACTAGAAGTATTTGTGGCCGGCAATTTGCTGGCACTCAGCGTTACTGTAAGATCTGGTAACGTCTATATTCGTTCCTTATCTGCT
AAATGGAATGGCGTCGATGGTCCATGGGGTGTGTGGCGTAATGTTCAAGCGTCAACTCGTCCACTTTCACAAACGATTGACCTTGATAGCTTGGGAG
AATTAGAACATTGTGGCTTATGGAGAAACAGTTCAAGAGCAATCGCATCATTTGATCGCCATTATCCAGAAGAAGGATCAGCCGCACAAGGATTTTT
AGAAATATTTGAAGGTGGTTTATACACAAGAACGCAGCGTTATACTACCCGCATGGGTATGGTTTATACTCGTTGTCTCGCTGCTGCATGGGATGCT
AGTGCACCTAAGTGGGAGGAATGGAAGCAGGTTGGTCATGGCACACCAGCGACTTTCTATGATGGAGATCTGAATGATTTTAAAACTCCTGGGTTAT
ATAATATTTTAGGCACTGATCGCCGTTATTAACTGTCCTACCGGTGAAGGTTGCCAACTACTGCACATACTTGGACTGCTCAACAAGATTTTAATG
TGGCCGGTGCTATTTTCCAAAAATTTACTACTGCCGGAACGGGTGCAACTACTCGCGATCGTATTTTTGAGCGTGCATATACTGGTGGTGTGGGGGT
ACATGGAACGAAGTATATACATCTTACTCTTTGCCAATTACTTTGGGTATGGGTGGTATTAAAGCCCAATTAGCGGAGCTAGATTGGCAAACATTTG
ATTTTGTTCCTGGTAGTATGTTTAGCGTTCCTTTGAACAAAATAAAGAACATGCCAGCAAATATGAATTGGGGTACAATTGACGGAAACTTAGTTAT
GTTTTCTGTCGGTCCTAGCGAACACACCAGCACAGGACGTACTGTTCAGGTTTGGCGTGGTACTGTATCCAAGACAAACTACCGTTATTTTGTCGTT
CGTGTGTTCGGTAATTCTGGAAATAGAACTTGCACAGTTCGCCGTGTTGTTCTTGAAGACGGATCACATACTTGGACTGCTCAACAAGATTTTAATG
GTGCTGTTAACTTTGGTAGTTCAACAACGTTTAAATCAACTACAACATTTAATACAGAAGTTAAATTTCGCTCATTGAATGCATTCCGTATGTATGG
CGGAAAATTTGGTACATTTTTACGTAATGATGGAGAGAGTCTTTATATTCTTTCCACCGACGAAGATGATCAAGATGGAAACTTTAATACAAATAGA
CCTTTTCCGTTATGAATTAAGAACTGGTGATGTTACTTTGGGTGGTGCTAGTGGTGCTAACGTTTTAAAATTAAAACGTGATTCTCTCACCGCATTTT
TTGGCCGGTGATATTAACATTAAAGGCACGATGACTTTTGACGCCGGACGTTTAGGATCACGAGATTATTTTAAATTTAACCATTGGGGTGATAGTAA
TAATGCGCGTGATAATATCATCCAGTTAGAAGACAGCAAAGCGCTCATTTTTCCACTGAACGTACTTTAGCGACTGGTGCAATTAAGACTAAATTT
TTTGGTGAAATTGAATCCGATGGTAAATTGGTTATTAAACGTCCGGGTAGTTCTATTGTATTATCAACAACTGCTAGTAATTCTTTGCATATTCGCG
GTGATATAGACGGGACTGGTAACTGGTATATTGGTAAAGGTGGTGCTGATAATGGATTAGCGTTCTATAGTTATGCTACTAATGCTGGTGTATACAT
TACAAACGAGGGGATATCGCGCTAAGTCCAAAGGGTGCCGAAATGGCTCAGGTCAATAACGTTCGATTATATGTTCATGGTGAACGTTGGACTGCT
AGTCAACCAGGTGATTGGGGTCGTCAGTGGCAAGTGGAAGCGCCAATATTCGTCGATCATGGTTATGTTGGACCAGATAGCTATTATCCAATTATTA
AAGGAAGAAGTGTAATCACCAATCAAGGGTTTGTAACTGCCGTCGATCTTGGTATTCGTCGTGTCAATAACAATTGGGGACAAGCAATTATTCGTGT
TGGATCTGCGGAGGCATCGCCAGCGGCTGGACACCCTAACGCGATATTTGAATTTCATTACGACGGTACTTTCTATTCTCCTGGTAATGGTAACTTT
AACGATGTGTATATTCGTCCGATGGTCGACTTAAGATCAATAAAGAAGAGTTAGAAAACAGGAGCACTTGAAAAGTATGCCGACTGAAAGTTTATA
CATACGATAAGGTTAAGTCTATTAAAGATCGTAGTGTTATTAAACGTGAAGTTGGTATTATTGCTCAGGATCTTGAAAAAGAATTATCAGAAGCTGT
ATCTAAAGTTGAAGTTGATGGATCTGATGTTCTGACAATTTCTAACTCCGCTGTAAATGCTCTTTTTAAGTTAAGGCTATCCAAGAAATGAGCGAAGAA
ATTAAAGAATTAAAAACGCCTTTCTTCACTAAAATTGCTCGCAAAATTAGTAATTATTTTAAATTCTAACAACAAGGGCTTTGCCCCTTTGGAGAA
AATTATGGCAGTAGTTGGTGTTCCCGGTTGGATTGGAAGTTCATCCGTAAATGAAACAGGACAACGATGGATGAGTCAAGCAGCTGGTCAATTAAGA
TTGGGTGTTCCTTGCTGGATGAGCCAATTCGCCGGAGTCGCAAGAGAGATTATTCATACTGTAAGTGCTAATCATAATTTTAATGGTCAGTGGTTCC
GTGATATGCTCTTTGAAGCTGGCCGGTGACGTTCACCCATTGTATTCAATATTGTTGGTGATATCGTTTCTTATTCTAAAGATGTTCCTTTATTCCATGTA
CGGGGATACGCCTAATGAATATGTTGTTCTTAATATTCATGGTGGTGTTCATATGTGGGCGTCGTGTGGTAATGGTGGATACACTCACTCAGGAGGC
GACGGTAACGGTACACAAGGCGGTCATGTTATTCAAAATGATATCGGTGGACGGCTTCGTATTTGGAACTACGGTGTTATAGCTGCTGGCGGTGGCG
```

Figure 13(E)

```
GCGGTGGTGGTATTGCATATCGTCCACACTCAGGGGCAAACTGGCAAGATATCGGTGGCGGTGGTGGTCGACCTTTCGGTGGCGCTGGCGGTGGCGG
TTATTCCGGTGGTGCTGCTTCGTATGAAGGTCCGGGTGGTGGTTATGACTATGGTAACGCACACTCCGGCGCTGGTGGTAATGCTGGTGCTGCTGGT
CAGAATGCATGGTCTGACGGCGGTAAAGTTCTTAAAGTTGGTGTTGGTGGTGCGTCTGGTCATGCAGTGTTTGGATCTTCTCCAACTTGGGGTGTTG
TTGGAACAATTTACGGACCAAGAGTATAATGTGAATAAATACCCTTAAAAGGAGGGTCTATGGCAGCACCTAGAATATCATTTTCGCCCTCTGATAT
TCTGTTTGGTGTTCTAGATCGCTTGTTCAAAGATAACGCTACCGGGAAAGTTCTTGCTTCCCGGGTAGCTGTCGTAATTCTTTTATTTATGATGGCG
ATTGTTTGGTATAGGGGAGATAGTTTCTTTGAGTACTATAAGCAATCAAAGTATGAAACATACAGTGAAATTATTGAAAAGGAAAGAAATGCACGCT
TTGAATCTGTCGCCCTGGAACAACTCCAGATAGTTCTATATATCATCTGAGGCAGACTTTAGTGCGGTGTATTCTTTCCGCCCTAAAAACTTAAACTA
TTTTGTTGATATTATAGCATATGAAGGAAAATTACCTTCAACAATAAGTGAAAAATCACTTGGAGGATATCCTGTTGATAAAACTATGGATGAATAT
ACAGTTCATTTAAATGGACGTCATTATTATTCCGACTCAAAATTTGCTTTTTTACCAACTAAAAAGCCTACTCCCGAAATAAACTACATGTACAGTT
GTCCATATTTTAATTTGGATAATATCTATGCTGGAACGATAACCATGTATTGGTATAGAAATGATCATATAAGTAATGACCGCCTTGAATCAATATG
TGCTCAGGCGGCCAGAATATTAGGAAGGGCTAAATAATTATTTGTTCGTATACATTTCTAGATATCGATATACACCCTCAAAACCCTCGTTGAATTC
ATCGATGAGGGTTTTCTTATCTTCTTGAGTTAATTCAGAAACAATTTTACGAAATGAATTCTGATTTAACTTTCTACCTTCATGCGTTACTCCAATC
TCATTAAGAAATGCAATAAAATTAGCACGATTCTCAACAATATCTTCTCTGGAAAATTTAATCAAAATAGATGCAACAGTAATAATTTCACGAACTG
TATCAATGTTTTATTCATTAACTATACCACTCAATTAGTTGACTTTGTTATAATATCATCAGACGCTTGATTTGTAAACTGGTCTGTGTTATTTTC
TTCAAAAATTTTTTCTATGAATTCCTTGAACGACTCGCGTTCCTGAGCTACATTGATGCTCGATTACCTTTTCAAGATTATGACTCATTCGAAATAAT
CTTCAATTTCGTAATCATGGACATAAATCATTATAGTTTCTAATACATCATCAATACTTTTTCCTGGAGCTGGAATTACGTAAAAATATCCTGCTTT
TGAGAGGTCTTTATAAGTTCCAATCAAGAAATCATTATTCTCAAGATGTAACTCTTCAACTAATTCATTGACAATTGAATGGTATAGGTTTGGTAGA
AACTTATATAGCTTTTCTAGAATATCAATTTTGATTGTGTATTGAACCACGGACTGAGAATCAATAATCATAGACCTTCCCCTTATGTTTCTGTTTG
CGATTAGATTCTTTAAACGCTTTCTTCTTATCCTTATGAACAGAAGCTTTATTAAAATTATGCTTTGCGACTAAATTGTTCATAGTGCTGAATTACC
TCTCTTAAACATTTGCATGTGAATGAAAACTTTTTAGCTACACCACATTCAAATATATGTTCTCTTAAATCGCGGTGTATCGGTATATCCCATCTCAA
CAATAAAATGCCGTATTAGATTTTTATCTTTATCGTTGAGAGAATTAAAATAATCGGATTTTGAATTAATTTCCCTGGCCAATTTGAATCACCTTCA
GTTGGCGTTTTAGCTCTTTTATCATCTCTTCGTTCATCGCAATATAAAGATCGCGTAAAGCAAGTTTTAGCATTCCATTTACTGGATAACTAAATGG
ACATACATAATCTTTTCCTACGAGCTTTTTGGTGAATTCCATATCACAGAACTGAAATGCCGGTTCATTTGTATAAATTCCCCAATTAGTTGACATC
ATTTTATTGGCATATTCCAACGCCTGGATTTGATTCTTAATTCCATCAATTTGAAACTTTTTAATATTCATTAGTAAAGGTCCTCAGAGTAAAGTTC
TTTTTCACTACCACCACGTTCAATACGCACTTGTCCAGCGTAAGTTGCAATAATCATTGCTTCTTCACGTGTCCAGTAATTGCTATACTGGTCAATA
AATCCTTGGTCTTCACCACAAACATGGTCTGATACAAGTTTATCACTTACCTGGTCAAGAACTTCAGCCATATCTTTAGAATAATGACGAGCACCAG
GAATAACCAGAGTCCCACCATCTTTTAACTTAAAGCGGTTGGCTGCACACACAATTCGACGTTGATATTTTCATTATTGTTCCAATGAGCTACTTG
CCAACAGATTTCAGGAACCTCTTCTAAAACATCCTCTTCCGTATATTCGGTGTAGTCGCCATAGGCCTGTAATTTAGCTGCTAGACTTTCTGGAGTT
TCACGTAATAAAGCCAGGTCTAATAATTCAAGACGCTCTTTGAAGGTTTTCATTTGGTTTCCTCAACACTTTTAATTTTTATAGCTTGTTTAGAACT
TTCAAAGCATTGACAATATACTCTTACCGCATCAAACTGGTTGGCCGCTTTAAGATGGCATTGGTACACCTTCGCCGTTATAAAATTCTACGACAATTTTA
AATGTTTTCATTTAAACCATCCTTTAATACGTTGCCATAAAGTTTCTGTTGAGCTTTGTTAACACCAATTGAGCGAATAACTGGTTGAGATTCATG
GAATTCTTTATAATCAGCAAGATAAATTTCGTAAGCTGAATCCATAAAGGAACTTATAGCTGCCATGAAATTATTGCGAATACCTACTGGAGCATCT
TTACTTTCACGAATAATCATGTATTTGCCAGTCTTAATCTTTACAATAGTTCCAAGATAAGCCCCATGGTACCAGATGTCCCACCCCTCCTGAGTGG
GTTCTGCACAACGACGAAGTTCATTGACAATTTCTAACTTGTTCATTATTTATTCCTCACAGTTCAGATGCTACAGTGATTACAGCTTCAATGTTTT
CTGCCGAGCGTTTAATGTCAAGATACACATTACCGTTTTTAGCGATTTTACATGACATTCCGATGTCAGTAAATTTCTGAATATGATGTTCCATCAT
TTTGTATCCAAAAATTCGCATATTTCCATTGTTGTTAATTTCAAAATTACGAATTCCGTGAGTGCGTTTTTCTAAAATAGCGAGATAGTTACTACGA
TAAGTTTCAACCTTTTTAAGAACAAATCCATTTTCATCTAAAAGTTTTAACATGAAGTCTTTATCTTCTTCCATATCAGAAGTAATCTCGCGAGCTT
TACGAGTTGCTCGTTTTTTCAGCAGTTCAGGAGCATTTTCCTGTGCATATAAAGTTGCCGCATTTGAAATAATATCCTGAGCTTCACCAGTAATGAT
TAATCCATCACCAGATTTCTCCACCAGGCCTTTTTTAATCAATACCCCAATATTACTATTAACTACTGCGTTACCTAAATCTGGATGCACCTCACGA
ACTTCTGCAGCTGTAATGAAATCTTTCTTAGCAATGGTAATTAAAATCGCAGCAGTTTTTCATTCAGAACATCGTTAGAAGCTTTGATGATGTAAG
TTACTTTAGACATTTTCTAATCTCCGTAATTCTGTATCAGTAGTTGATAGTTGTATAGTACCACAGTATGCTTTGGTTGTAAACCGTTTTGTGAAAA
AATTTTTGAAATAAAAAGGGAGAGCCGAGGCTCTCCCTAAAATTACTGCATGACTGTGATAACTGTCATGATAACACGTTGAATTCCGAACGCAAG
AAGACCTCCTGCTACGGCAGGAACAACACCTAAACCCGCCAGTAAAATGCCACCAGATACTAATGCAGCGCTTGTGATACCAATGAATGGACTCATT
TGATTTCCTCTAAATCTTTGGTGTATTCTGTAACTACATCAGTAGTTTTCCAATATTCGTTTTCTTCTTTTTTGGCTTAGTTTCTTCAGCAAGTTT
CTTTGCTTCGTCGGAAGTCATATGAAAAATGTTCATTCCAACTAGTTTATCAACATAAGAAGAATACATATCAATTTTAGAAAGTTCTTCGGTCAGT
TCTTTGCGAGTTTTACCTTGTACAACAATTTCACCTGAAATTACTTTCCTTGAAATTACTTGCCTTGGCAAAAGCTAAACGAAATGCTGATTCAGTTT
CTTTGATTTTGTTATCAATTCGTTTTTGGACATAAGTTTTACGAACTTCAACGAAGTCTTTGATTAAATCAACTACATTATCGTAAACTTGCAGCTT
TCCTTTCTCATTAATGACGGTAATATTCTGGGAACGACGCTCAATCAACCCGAAGTCTTTCATAATTTTTGCATGACGTTCTTCTTCATTATCGCTC
AAAGAATATTCTTTGCGGAATTTAACTTTGAATCCAAAACCATGCTCACCGCAAGCATCATCCCATGTAATGAAGCCTTTATCTTCAAGTGGGTCTA
AGATTTTACTCACGTAAGTTTCACGATCATACTTATATGGAATCTCAGTGATATGCATTTGAGTTCGTGAAGTAAACTTATATGTTCCACGAATTTC
ATATTGCCCATCAATTTCAACGACTTCACCACGAGAATTCTGGGAATTACTTCACCTTCCGGTTTAGTTACTTCTTCCTTGAAGAGCTTGTAATACAGCT
TTCTTAACAGAAGAAACACTATGAGGAAGAATGTAAGTTGCATAACCAGTTGCAATACCGGAAACGCCATTAAGAAGAACAGTAGGAATAATAGGCA
AATAGAAAGCAGGCGGAATGTGTTCTTTATCTTGATGTACCGGAGCATATTCAGTATCTTTATATACGTTATAGAAATTTTACTTACACGAGCAAA
AATATAACGACTTGCTGCTGCTTTTTGGACGGTACGAGAACCAAAGTTTCCTTGACCATCTAACAGAGGAAAATTATTATTCCAAGTGTTAGCCATC
AAAGCACCTGCGTCTTGCGCAGAGTTTTCACCATGATGATATCCAAGGTCCGCTACACACCTGCAATAGAAGCGAGTTTGTGAAACTTATCTTTAT
TTCCTCGTGCCAAATCAAGAGCTCGAGCAATAACAAATCGTTGAACTGGCTTAAATCCGTCAATCATATTTGGAATGGCACGATTTTCAACCGTGTA
CATAGCATAAGCCAATGCTTCATTATCAATGATACTTTTTAAATCGCGATTATTCAGTTGCATAAATTTACCATACTAGTGAATGTAGTGCCATAAT
AACATCAGAAATGAAAAGCACGACTTGAATTAATCCGAACATTACTCCATAATATAGTGCTACTAATAAAGCAGCAAGGGCTAATGAATAGCCCAAG
ATTTTCTTAATCATTAGTAGATAACAACACAAATGTTAAATATGCACACATACCCTGGGCTAAAGCTTGTGAAAACACACTGCTAGCATCGATACAG
ATAGTTAAAACACATGCTACTATCCAACAAATAAATGAAATAACTCCTAATAATTTTGCGATATTCATATTTTCCTCACTGGCGTCCGAAGACGCCT
TTGTTTTTAAGATTGTTACGATAGAACTGCATCACATGTTCGTTATGGAAATTACTCATACACCACACACATTTTGCATAAAGCGTCAAAACAGATA
AATCCGCCACCTACACACATCACGACAGCCACATTATCATTAAGAGGTAGACCTAAAGCCGTAAAGATTCCAGTCAATGTGAATAAGGCTAAAACTA
ATAGGTAACCCATTACAAATAGAGCTTTCATTAGTATGCCTGCAAAACAAATTTAAAGTTATCAGCCAACATACGGTTCATTTCTTCAAGTGTTTGA
TACTCAGAATGATGATTACGAGTAAACGCTAAAGCTAACTGACCTTTTCCAAATCCTGTCGTCAAAGGTTTCATCTTAGAAGCAGGAAGATAAAATA
CTGCATATGGAACATTGTTATTTGCAATAGTACGCGCAAGCTGAGACCGACGTTGACGAATATGACTTAGAACTGCGCTGAATCCTTGCTTAGAACG
TTGATTACCTACATAAAATCGTGCAGACACACATGGATTACTAAATGGACGACCATCTAATTTACTTACTAAAAAGTAAAATCCAGGTTTAGATAAA
```

Figure 13(F)

```
ATATCTTTATGCGGAGTTCCCAAAAACCACTCACCACCCTTGATTGTACCAATAACAGTAGCACCTGCATCATTCAGATCAGTAACAGTCATATATT
TCATATTAATTTCCTCTAAATTATTTTCTACTCCAAGGCCGCATGAATACGCGGCCATTAAATTAATCGTCGCAGTCGACGCTCAATTCCCAAAACT
CTTCTACGGTATAAGTTTCAGTATCATTTTCAATACAGAAACGTTCATTACTGTTATTTGCTAAAGTAGCGTTAACTGTCATTTTCTCGCTGGTGCT
CTTAAGAGGTGAAATACGAATTAACTGATCACCACTATCCAAGCAAAAAATTTCACCAACTTTTACATCTTTAAAGATTTTCATAATTCACCTCAAG
GAGTATAAAATCCAAATGCAGTTGTTGACCATCCCATCCAATATGGAAAATTTGCGCCAATGTAAAACATAAGAATATAAAACCAACCACTCAGCAA
ATTCATCATTTTACACCATTCCAAATTGTTTCAACCACGGATTTTAAACCATTTTGATGAATATCCATTCCGACTACCGTCATCAAATAAATTCCAA
CTACAACTGAACCTAAGGCAAAAATCAGCATGAAAATGAATAAAGCCGGAAAAATATTATCGAAAAACCATTCAATAAATGTAAAAGCACTGCGTTT
ACGCTTCATATTTTCCTCACATAAATCCAAAGTAAACGTTTAATACATCAATCATTAAAACGATTGGGAATATACTCAAAACTATTAGTATTATAAC
TACATTCCATATAGCTTTAACAATCTTTTTCATTTTCTGTTCCTCCGTAGTTGATAGGGTAATAGTACCACGGAAGAACAGTCTTGTAAACAACTTT
TTAAAAATATTCGTAATAAATGTGAATACCAATCACCACTGCTGAAAACCTGTGCAACCCACCACGCACAAGCAATAAGTACAGAATTCAAAATTTTC
ATAATAACCTCATCACAAAAGTAAATGTTAAACAAATTAATGGAATACTAATTAACCAAACGAAACACCACCATAATGAACTCATAGTTCAATCTCA
GCAATTTTCATTTCATTACTATTAATAGCCGCTTTAAGACTATCTGAAAGAATTACATTCCAGTGGTCATTCATATGACCATTAACTAAGCGTGTAA
TTTCTTCGGGAGTTGAAAAATAAGGCGTATCAGACTCCCAATGCGATAATCCTAAGCGAGTATAAATCATACCTTCATCATCGCTAGAATATTCAAC
TGACACAAACTCATCAGTTATTTTATGTTTAGCGTAATAAAATTTAAATTTCATTTTCCGCTCCTCCGTAGTTGATAGTTGTATATTACCACGGTCC
TTGTGGTATGTAAACCGTTTTGTGAAAATTTTTAAATGGAAAGATACCATCCGTTGTAGTTGCTTTTTCTTACAACCTTACGAAGGTCTTCTCTGTC
ACCGATGAACTTCGGAGTGTACTGGATGACACCTGGGTGAATTTCTTTAGTGTTGAATATAATTATACAGTCAGCGACCTGATGATTCAGAATGGGC
CCTAGATTTATTCCAGAACCATATGGATACTCTCCGCTGCATCCTGTTGTTACAGAAATCCAACGTGAGTCAGTTTGATGTGTCTTAACTTCTACAC
GAAGCCCGCAGTATCTTGGATGCGCCAATACATCCCATGCGTATGTATACGGGTCATTAACGTCCTCTTGGCCTTTGTTAACATACCCGCTTAGCCA
ATCTGCTACAAAAAACTCTGCGTACACCGCGATACGGCATCTTTCGATAACTTCTGCCTTATCCTGATTTGGGTTTTGTTTTAAAGAGTATCTTGCT
GTATCAGCAATTTTGACCTTCATTTCACTAGTCAAATCACTGTTCGATAGGGTAAATGTCGGAATCTGAAATAGTCTCTGTAAACCCGGATTCGTTT
TCTGCATTTAGACTTTCCTTTTTACCGCTGAGATAAGCGTTATATACTTTAAGAGTGCCGTAATAAATTCGGTCATTTTCATCTAAAGACTCACGGT
CAAGTTCATCGAGTTCCTTTTTATCCATGACTATAACATCATTGCAATAAAGAAACCCAAGTTTTTTGTGTCCAAACTCAAATTTATTACAGTACAC
AATATTAGCGTGATGATTACCATGTAGAGAAATTTCTTTTATGTCGGAATCACCGATATTCATACAATAAATCATAATTCACCTTAAAACAAAAGGG
CCGAAGCCCTTATTTTATTTGAATTGTGCAATTCTTTTCTCTAAACAGTCAGCATAAGATTTCATTGAGATAAACTGCGAAAGTAACAGTTCTTGCT
CAACTGCACTAACTGTTAGAAACTTTGCGCTTTCTAAAAATTTGCTCAGTGCATTAATTTTGAGCATTAATTGATCGTATTCTTCTTTTACTCGTGC
TTGATAACCTAACATAATTTTCCTTAGTTAAGGGCCGAAGCCCTTATTTAAATTGTTCAGTAACGTCTTCAACTACTTCGTATTGACAGGTACGCAT
TTTAGCATCGTTGTAATCAATCGGAATTGATACTACATCACGCGGATGTACTTTAACTTTTACAACTCGGCTGGTTGAACTGCCAAAGTGACGAATA
TAAGATTTAGAACACACATGCAGACCGCGAGAACAAGTTTGTGTATCATCGTCATTCACACGAGTACGTGGCATTTTAACTACTTTACCAGGACTGT
TATCAAAAGTATTTGAATGACAGTCAAAGTAGTTGTCACGAACTACTTTCCAAGCATAGAAGTAACCATCTTCGGTGATTTCAATATCGTTTGCTAC
CAAGAAATCAAAGAGTCGAGATACCGCTTTCTGGCTTGGGTTTTCCAAGCAGATTTTCCAAGAACGGAAAATAAAATTCAAAGTTTTCGCCTTTTCC
ATCGAATCAAGAATACGATCAACCAAACCAGACCGCAATTCAATATTTTGATAGAATAAGCTTCCACCTTCAATTCGAACATCGCCGGAAATATATT
TTTCAACAGCGCGACGAACATTAATTTTTTGTGCCGCTTCTTCCAGCTTATCCGCTACAAGCAGATTGAGAATTTCCTGGAAGTTTGAATGAGTATT
AGGTGTTGCGTTATAAGTTACACCGTCAACAGTAATTGAAATGAATTTTTTAGATGCATTCCAAATAATGTCAGATTTAGCAACTGGAGCAATAACT
GCATCGCTATTAACTTTAACTGTAATATCACCGCTAATAGTAACTTTAGAGCGTTTAGCTTCTTCAGCATTTTTCAAAACACGACGAATTGTGTCAA
CCGATACACCTTGCCAATCAGCCAATTCCTGTTGGGTGTAATTACCACTTGAATACAATTTAACAATTTCAGCTTGCTTGTTCGTTTTTGGTCAGGCATTT
AATATTGTACATAATTTTCCTTATTAGGCCGCAAGGGCCTTCATAGTTTTAGCGATTTGGGAAACTTCATCATCATTTAAAGAGTTGCGATAACCGA
TGAAGTCGGAAACAATACGGAATTTCTTGGTAAACTCAGCAACCATTTTATCACTATTTTTTGAAGCATTACGTGATAATTCATCAAAGAGATTAGT
TACTGTCCAGATATCATGACCGATGGTATCTTTTCCACCATTGAAATACACACCGCGTAATGAACTAACCATATTACCAAGTCGTGTATATTCTTCA
GAAACTTCGTCTGTACTGAAGTACTTCATCATAAAATCTAGTTCAGGATACTTGATAATTTTATCAATATATCGTTGAGCTGAACTTGAATAACCTA
CATACTTATCATAATCTACATCATCAAAAGCATCTACATATAAATCACGCAGAGTTTCAAAAATACATTGGCACTGACCGAGTTCTTTTACCTTTTT
CTGCAAAAGCGGACGAATAACATAAAATTCATTAATGCCAATAAGATTAGCCATCAAAATATTCATAGATGGATGACAAAGAGATGTAGTA
CCATCCATAGAGAAAATATCAGAACGATGCATATACGCTACATACCCAGTAATTTCATCTGCTTCTGATGTGAGCGTAAATAATTCCTCTTTTTCCC
AGCGCCCGTCTTTAATTTCAAACTTAAATGCTGTAGCAGCTTTAGGACGAGGAGCTTTACTTTTAACTACCCTTTGGAATATAGCTTTTAACTAAAGC
TTCAATTTCTGACAAATAATGAATGTTAACTTCATCACTTTCAAACATCGCCATAATATCAGGAAGCAAATCAATCTGCGATTCTACTTCTGGATTA
ATAAACAGAAGGCGCTCATTGTGATGAATATTCAAAGTGTTATTAAATTCACTATCATCTAACGCATGTGCTAATCCACGACAATATTAACACGAT
TTTTAATATTATCAATAACGATATTAATTTGTTGTATTAATACCAAACACGATAACTTGATGCAACGGCTGAAGTTTCATGACTTTGCTTAAT
GCGTTTCAGTCGAGGGTCAAGATTTACTTCATACACCACGCCTGCATTGCATAACTTACTATCAGGTTCAAACATACTCTGCATCTTCTTATATGAC
AGATTTTTAGTCGTGAATTTGACTGAATTACTAATCATATAATCTCGAGCAGAATACCCCATCTTCATTAATTCGCGATATGTATGACGAGGAGATG
TAGATTCTTTAAATCGTTTTACATCTTCATTAAATGCTTTCTCACTGAGTTCTTTAACTCGTTCAATAATATTTTTACGAGTACGATCATCCAGTGA
AAGAGCCTCGCGAGATGGAGCAATATCAAGTGAACCCATTGGAAACTTAATGTAATTCACTTCATTGCGAATGCTTAGCCAGTTACGGTCTCTAATA
ACACCATCGATAGGATAAACAATACCGCATAGATAGCATATAATCCACACGATCAGGCCGATCTCTTCTGGATTTACACCGTAATAGTCATCAA
AATCCGGAAAATAATCAATTTCGCGGTCAAGACCGTTAATGATAGCCAAATCTTTGAATGGTCGCATGATATAAGAAACTTCATAAGCAAAGTTTCT
AAAGTCTTTTTCTTCAACTGGAACTACGATTTCAATACCAGTTTTATCATCTGGACCCATTTCTTTTACGAATGTAGGTTTAATTTGTGGACCATCA
CCATCCATGTAAGCTACATAACCACGAATTTCACCTTTATGATACGAAGTAATACTAAATGTATCAGTATAACTAAACGGAGATTTAGAACCTAAAC
CAAACCCGCCAATAAAGTCATTAGATTCAGCCTTAGATGAACTGAAGTATGAATTATATAACCCAGGAGAATTATCATCCCCTGAATATCAAAATC
ACTCATACCCGGACCAAAATCTCGACAAACAAATCGCGGATCTAATCGTCCTGGAACTTGTATGATAAATTTTTCAGGATTTCCATTAAGTGCATGG
GCATCAATCATATTAGTAATTAATTCACGGACTACTGCCACGAATCTTGTTTGTATACAAATCAGATGACAGAATTTTAAATACTTTAGGAGATGCTG
TGATGCTAAATGCTTTTGATTTAGAACCATTGCCAAGAATTGTTTCTTTTTCAGTGGTGATAATCATAATTTCCTCATTAATTCATATTACGCTTAA
TAACTTCAGCAACTTCTAGTAATTCATCTTTAGTTGCAGTGTCGGATTGAATTTTATCTCTAATATCTTTAAAGCGGTTTTTAAATTCTTCGGCTTC
TCCCATATCGAAAAGCGTTGAATGATTCTATATTCTCGATGAACTGCTTTATCAAAAAGTTCTAAATTTACTTTATATGATTTCATTTCAATATCC
TCATTTGCCCAATTAATTATACCACATCCTTGTGGTAAAGTAAACTACTGGCTCATCCATTCTTTACGAAGGTCAGCATTATCTCCCATGAGCATTT
CAAAAAGCTCTTTCCAGTTCTCAGGAAGTTTAACAACATCATATACTGGATTTTGAATCATCTCACGATATTCAGATTTTTCCAAAGAGCCAAGTCC
TTTAATAACGGATGCTATGTTTAGGTAGAGCATCTTTAGCACTCTCATATTCAGCGACTGTATAAAACCATTCTTGTTTTTTACCGACCTGAGCG
ATGATTACAGGAGTTTTGACAAAACGAATTCTTCCTTGCTCAAACAGTTCTGGCCAATTACTAAAAAACCCGAGCAGAGAAGGATAAATGCTTCCTA
GACCATCATGGTCAGCATCAGTCATAATAGCAATATTATGATAATTCAAGTTTTCAGCTTTTTCACCGAGAACTAATCCAGTGATTGCGCAAATATC
AAACAATTCTTTGTTTTTAAGCATATCAGCATATGACATACCCCAACTGTTGAGAACTTTACCGCGCAATGGATAACCACCATGAAGTTCTTTATCA
```

Figure 13(G)

```
CGAACATCAATAAGATATCCGATAGCAGAATCACCCTCAGTCAAGAAAAGAGTAGTGTCAGCATCTTTACCGCAAAGATTCGCTTTAATGTGTTTAT
GAACCTTAGCTTTAGAAGCCTTTTTAGCTGCTTTAGTTTCTGCTGCCTTTTCTGCCGCCAATTTACGAGCCAAAGCAGCTTCAATAATTGGCATTAG
AATTGCTTCATTATTTAGAATAGCACGTGAAATCTTTTTAGCATCAAGTTGAATATGACTACGGATTTCGCCAAATGGAGAAGTCAAACGCTCTTTA
GTTTGAGAATCAAATCGCATGTTTTTCATATCACGGACAAACATAACGATAGTCAAACATTCTTTAACGCGTGCTTTAGTCACATCAATTTTGAACT
TACGTTTGATTTGTGGAATAAGGTCTTCACAAATATCATCCATAACACAGTCAATGTGATGGCCACCATTCTTAGTGTGAATGTTATTGACGTATGT
TAATTGACGAAAACCATCCGGTGAACGACCAACCGCAATAGAGCAATTTTCTTGTTCTTGAACAATAGCATGCTCATCATATTGGCGTGCATATTTC
TTAAAATTGCCCTGAACCTTTTTACCATTAAAGGTAAATTGAATATCAGGATAAACTACTGCAAGTGTCTGGAGACGATCTAGTGTAATGTCAAGAT
AAACTTGGGACAGCTCATTAGTTTCAAATGACATAAAATCAGGAATGAAAGTAACACGAGTTCCTTTCCATTTTCCAGGAATAGTTTCCCATGATTT
ATTTTCCATGCCATTTGAACAACGAACTACAATATTATTTTGACCATCACCAGTTTCACCGACAAACATCACAGAAAAAATGTTTGTCAAACTAGAA
CCAACACCATTCATACCGCCAGTGACGCGTTCTTTATCATCACCGAAGTTACCACCTGCTTTTGGAATAGTCCATGCAGCAACAGGACCAGGAATTT
CTTCACCGGTAGGTGTTTTAACCATCGCCTGCGGAATACCACGACCGTTATCTTCAACTGTTACTTGATTGTTTTAATAGTAACATTAATTTTATT
TGCGAATTTAACTTAGTACGAATACCTTCATCTACTGAGTTATCGATAAATTTCATCAATAAGCTTAACAAGACCAGGTACATACTGACACTTTCC
CATTTACCAAACAGAAAGCGCTCATGCATTTCATTAGCAGAAGAGCCAATATACATGCCGCTACGCTTTTTGATATGTTCAATATCGCTCAGAATTT
TAATTTCATTCTTAATCATCACTTATCCTCGTTTGGTTTCGGGAATATTATACTCCGGTAATCATAAAGCTAAAGGCCCGAAGGCCTTTTATTTAAA
ACGGATAGTCGAATCCTTGAAGAATAGACCAGAACACACGGTTCCTTCTACTTTCTGCCCAGTAGGTCCAATAGCACGAAATCCAGTATGTTGGAAA
TCATTTTCAGAGCAACCGAACCAGTTGTATCCAGTGATTTCAATATTAGTAAAACCACTTGAAGATAAAACTTTGGTTGCATTATCAGCATCAGTAC
ATCCTGCTAAAGACACTGCTAATACTAATGCTGCGATAGAACGATTAATATATTTCATAGTTTTCACTTAAATTTAATGGCTTGAAGGAGACTAATA
ATTCTCAAGCGACTTCTTTCATCTTTAACCGTAAATGAAAGAGGGGTCACCAGATTTCATAGTGATAGTGCATTCAAAATCAAAACCTTCGGGGACTT
CTTCGAATAGGTCAAATTCTTCATCATATATTAGAACATTACTCTGAAAACTGTGAAGAATTTTTCCATCATTTCCAGATGCTGTACTAATCATTGT
AACATTATTACCTTTCATATCTTCAACGATAAATTCGCTTGTAGATATTACGGCATTAATAGAACCATTCCTATAAATAGCAGAAAATAGATATTTC
TTTTCTTCACCTTCGCGAATGCGATATTTCTTACCAATTTTAAACATAATTACCCTTTAAGTAAGTCGTAAAAACCACCATTCACATGCTTAGGAGC
GGAAACTAACCGAATAGCAATCCGATGACAATCAGGACATACATCAGTATCCCTTTCAGAAATTTTCTTGATTTTTTCGTATTCTTTTGCACAGTCT
TTGGATTGACATTTATAATCATAAAGCGGCATAATTATTCCTTAAAGTGTGCTTTCAACATCTGATACAAGGACCATGCTTGTTCATTATTTTCAAT
AGTAACGTTCATAACCGGGAATTCAGATGGATCAGTTATTGTTGCAGATTCTTCCTGCTCTTCAGCTGCCTGGTATGGATTTTCAACTTCATTAAAG
AATTCAGCTTCATTCGATGAAAAGCCAAATAAAATCTTCATCCAAAATATCTTTACCAGAAGATAGTACTAAATTTCCAGCAAATGACATAATTTTAA
TAGGACGCCCAAGAGCATCCACATCTAAAATTTTAAAAGGATGCATACCTAAACGGCGTGCATAGATTCCGTTATCAGTATGGTCTTTAATAAAATT
TTCTTGAGCTTGTTTATTTTTAAATTGATACCATTTATTAACTTCAAATTTAATAGCCATTAATAAATTTCCTTCCAGTAAGTTGTACCATCTTCAG
TGATTTCACGAAATACACCGTAAATTGGTTGTTTATCCCCAACCTTTTCATACACATAAACCGAAGTCAAGTGAGTAAACTTAGCAGTGTGTTCCTT
TTGAACTACTACCAAATCTGGATCGAATAACACATCTTCAAATTCGTCATTAGTGCAGTTCTGAACAATTTTACGTTTCATTACAATTTCCTCGTTA
ATTGAACATTGGAGCGATGCGTTTCAGAAGAGTAGCAGCACCTTTGGCAAATTTTCCATTTTATTCTCCAAATTATTTTCTATATCAGTAGTTGATA
TTGATATAGTACCATAATCAACTACTGATGTATATAGTTTTATGAAAAAATTTTAAACTTTATGCATAGCGAGCTTTGCTGTAGTGTTTAATCCAAC
TTTCAGGAATGACTTTGTATGTTCCTAAAAATACCGCGTTGTATAACTTAACGCCATCTTCTACCCATTGATCAGTAATGTATGCACACATAGCGCG
AGTACGCCGAGGAAGTGGTTGTCCACCTTCGATAAATTCAAACTCATAAGGAGCAATGAACTTGATAGCTTGACCGAGTTTCCACTTAAAGTCTACA
CCTACATGCAAGTATCAATCGTTTCAATTCCTTTAGCAGGAACAGCTTTCAAAAACGCAGGCTCAAGAAATTTCCATCGAACATAACCAAACTGAG
GTTTAGACTTTCCATCTTTAGGAATGATACGCACTTTTACTTCAGAATCTTCATCTTTAACGCCGTGTTTAAGCTGAATGCTTACAATTTCGACCAA
TTTTCCTGCTGCTTTAGAACGGGATTTATCAGATACACGAGCAATTTCACCAATATTAATAATCATAGTTATCTCTCACTTGTTAAAAGATTTTAT
ACTCCACAGGACCATTATACTCTGGTCCCAAGAGTTTGTAAACTATTAATTCAAAATAGCTACCACCGCACTACGAGGTACTACACTAAAATCTCCT
GCATGGACAACGTTCAGAAGCTCAACACCATCTTCAATCCACTGGTCTGTTACCCAACCACAGATAGGATTATCAAAAGGACGACGGATAGACACAG
CAGCACACAACAGGTCTGTAGGGTCTTGTTCTTCAACTTCTTGGAACAGGATGAACTCATCTTCATAAACCAGGTTTTTCTTTATTTTGTTATTATC
TAACCGGCGACCTGGATGACGTAAGATTTGTCAAACCACTCACTTTTGGCAAATTCTTCAACAATAAATTCGCCTTCGCCAAAAACATCAGTCAGA
GTTTTATGACCAGAAATCAAGGCATTAGTTTTAATTTTAGGTTCAACCAGTTTGTAGGTTTTGCCGATTTCAATAGCGGTAGTCATAGTAGGTTCCT
TAATTTCCAGTGGTTTAACAGGGCATACATAAGTACTTACAACGTCAAAATCAATCAGTTTAGCTGCCGGATTCGGTGTGTATTCAGGATTATAATT
AAATTTCATAATTATCTCATTTCAATAAAATCTACAAGTTCAGCATGGGATTTACGGAACATTACTTGATGCCCGCCAACGATAACTTGGTCATCTG
GTACTTCGTATACAGCAAGATAAAATCCTTTAGAAGATAATTCTTCCCGCTCTTCTCGTGTGAACCATCTCATCATATCATATTCGCTAGCGAAAGC
AAAATGATAAAGAGCTATAAACCATCCTGGAATATGATATTCTACTCCAACATAATCTTTCTTGAACTTAGTATTAATTACTATATTAGCGTTTTTA
ACTAATAGTTTATCTTCGTGTGTAAAGGAATTCTTTTATTATTATCGCTATGATGCATAAAATTAGGTCTGTCATAACCATCATGTAATAGCCACT
CTTCGCTCCATGAATCTATTATACTCCTGTACGGCGTTATTTGAACACAAAGATTTCGACGTATTGTTATAGCATCTTCATAATCAAGAATACTAAA
CGATGATTCAACACGATAAATTTTCATTTTATTATCCTCAGTAGCTATGGTGTTATAATACCACAACTAACCGAGGAAGTAAACAACTTTTTATCGT
TTTGTTGGAAGAGATAGAGGATCGCAATCTTCCTCTGATGGAGCATCTTCAAGACCCATAGCATATCGCAAAGCGTACTTCATCATCAGAATATCTT
TCGCACAGTCATGAATAGAATCATGCGCAACGAATCCATCTAAAGTTCCTTTTGGAAGAGGACACGTGGTCATATCACGAACAAGCAGAAGTGCTTC
AATTCTGGTACGAATATCACGCTGATTCCAGAATTTACATGGTTCTAACTTAAATGTGTCAAGCTCATTCTCAGAAACACCATTAAGACGTTGAATA
TCACGAATGAGATCGACTAAAATTGGAAAATCAAACGACATTCCACGGCACCAGCCTTGAGATTTCCAAGGATCGATATTTATGTGCATTGATGTAAT
CATTAAATTTTGCAATACCATCGATGGTGCTTACATCTTCATCTGATGGTGCAATATTTTTTCGAGCTTCAGGAGACTGATTTTTCCACCATTCGAT
AGTGCTTTTAGTAAAAGACGATGTCCTTTTTGGCTTTTAAATCAAATTTGATTTTAATGCCGCGTGAAACTAATTCATCAAATGTTTCAACTACT
TCTGGGTTAGGGTCAAAAGCAATTACAGCTAAATCAATAACAGCTGCTTTTTCACCACTTCCCATTGTTTCAAAATCTATAATAAAATCAAACATTA
AATTTTCCTTGCTAAATCGCGAATTTGACTCTACAGTATAGTCTTGAATATAAATTTATTAAATAGGTTCATCAATAAATTTTGCCATAGATTCAATA
TCTTTTTGCATCTCTTCAAGACTGTATATTATCTTTAAAGCTTTTTCGCGAATAGTAATATTTTCAGGACCAGGAATTTTTCTCAATGACAGCTTTAA
CATTTGTCATAAGAGATTTAAACTGACACCAACTTAATTCAATCATTAATAACCGCCTTATAAAGATGGCTAATTTCACCTAAAATGTAATCACTGA
TTGTAACAGTTTTTACTTCACCACAAAAGAATTCTAACGCAATCAAATCTCGTTCAATTTCTTCCAATTGAAGCATTAACTTGCCTGATTCAATTTT
CACGTTTTTGCGATTTTTACTATAAGCTATTTCATAAATTTCGCTAACTTTATCCTGAAGAAGATAAAACTGATCTTTAGTTATTTCCACGAATAGC
TTCCTCAAATTTAATTAGTAATTTACAGACACTTTCATCTAGTGTAATTACCGTATCTGTATTACTGTGATATGATTGTTTTCAATTCGTTTAATT
GCTAATATAGTATCACTTATAGAATAAAAGCTTATGAAGGAGCTCAGCTCTGTTACCATAACATTAAGATTATCTTGCTTATTAGTATGCTTCCTTA
TACCATCTATTAGACGATTTAAATATTTTGAATTGATGTTAATCATATAGCCTCACACATAAAACATCATAACGACCACGGGTAACACCAACATA
AAGAAGTTGTTGGGCCAATTCAGCATCTGCATAATGAATACAAGGCGTATAAATGAAAGCACGGTCTACAGACATACCCTGAGCTTTATGGAATGTT
GATGCAGGAAGTGCTTTCACTTTACTAAACTGTGATTTAGCATCCCAAAAATCACTCCATGGAGCTTTTCCGCCTTTGTTCCAATTTTTATAAGTTT
CTGCTGTTTTACCTAAAAATAGATTAAAACTTATATAACTCTTCATCAGATGAAATTATTTTAATCTTTTCACGATAATATTCATCATCGCCGTAAGT
```

Figure 13(H)

```
TTCTACTGTTAAATCCCAATGACGAATTAGATATTCCCCAGGAACACCACGAGCTTTAACAAACGTTGATGTATACTCAGCTTCTATAATACGAACT
AATTGTCCGTTATTAAAAATAATTTCTGATACAGGCTTTCCATCAATTTTATATGTTTTAATTAATGGTTCCTGCATTACAATAATTTCACCAACAA
TAAAATCTTTATCAGTTTCAAAAATCTTTTTACGAATAATGCTATTTAACTTATCAACAGATTTATTCGTAAATGCCATTACGCGATTTTCAAACAA
ATCATCTAGTGATTTGACGATTGAAAAATAATTTACCATAAAATCGCGTAAAGCGGTATCACCGGTAAATCCACGTACTCCATGCCCGTCAACAACT
TTATCATAAATCCACTTACCGTTACGAACATCAGTAGCTACATCAATAATAGGAGCATTACTGCGTTTAACTTCAGTAAGTTCACACTGATAAAAAT
CTTTGTGTGTAAAGAATGGACTGATATAAGCAGTATTTTCTCCTGGGTCAACAGGTCTAATTTGCTTATTATCACCTATTCCAATTATGGTACACCA
TGGCGGGATAGTTGAAAGCAGAATTTTAAATAGCTTTCTATCATACATTGACACTTCGTCGCAGATTAATACTCTGCATTTAGCTAAATCCGGTACT
TCTTTTTGTTCAAAAAGAACGTTTTCTTCATATGTTACTGGGTTAATTTTAAGAATGCTATGAATAGTACTTGCTTCTTTCCCTGATAGTTTTGAAA
GAATCTTTTTAGCCGCATGAGTAGGAGCTGCTAAAATAATACCAGTTTCACCCGTAGATATTAAAGCTTCAATGATGAACTTAGTAAGAGTAGTCTT
ACCGGTACCGGCAGGTCCATTAATAGTTACATGGTGTTTCTTTTCTTTAATAGCCTTCATAACAATGTTAAAGGCATTTTTCTGGCCTTCGGTCAAA
TCATCAAATGTCATCGTAAATTCCCTGCAATTGGTATACTAACAATACGCCCAGTATCTAAAATTCGCTGATATAATCTTTGTGTGTCTACGTCGGG
CTTAACATGTTTAACTTCTATTTTATTAAACCAAAACTTGCGTGGAGTCTCAACTAATCTTGGAATTCCCTTACCTAAAGCTAATCGATACTGCTCT
TTAAGAGTGGTAAATACTTTATCAGCAATCTTCCATTCAAAAAATACAGCAGGACGATGTTCATCAAGTGGAACTGGCGCAATAAATCCATCTTTGT
CTCGGTAAACTATCGCATATACATAAACCATATTATCCTCGGATAAGTTTAAAAATTGAACAATTTAGCGGATATCCTCTTTTCAGTTTAAGTTTAT
CAATAAAAGACAAGTTTTGATACCGCTCTACACCTTGAATAATTTTATCACACATATCATATTGCATTTCTGCTTCTGACAACTTTTTCACAATTTT
CCAATCCGAGCCTTTAAGAAGAACGTTCAGTTTAACAACTTCAGCGCCTTCTGCTATGCGAGAACCATCAATACGAGCTTTAAGTGCTATAATCCTT
AGCTTAATGTCAGAGGTTTGTTTTGATTTAGAAAGCTGTGAAATGTGTTCAATTCGGTTTTCACGTTTTTTCTGTATAGCTTTAATTTGATTATAGG
TCTTTTTGATTTTAGCCCATTTCTTTTCATCTAAATTTAGTTTTATGAACTTTTTTCGCAGATGAACGACCAATTCGCAAAGCAAATAAATCACGCTT
TTCAATCAACTCCTCTAAAGTATAATCAGAACGAAATGTATTATACTTTTCTTTACTGCAATAACATTCCCTTTAATGTATCCAATGTTATTATCA
AAACGTTCTAATGATAATTTCTCTCCTTCAATACGATTATCAAAAGGTTCTCCTGAGTAAGCGCAAACTTTCTGATCTAAAATGTTCTTAATGTAAT
TGAAGTCTAAGTTAAAATCTTTAGAACGTCTTTTAGCAGATGCCTGAGTGTGCTCTAAACGACGTTTAATTTTACGAATTTGATTATTAGACAGTTT
CATATTTTTCTCACATCTTACGGACGATTTAATACTTACTATAACATTTTTACTTCAGATTGTAAACAACTTTATGCAAAAATGCTTTAAAAATTTC
ATGGTATAATGAATCTAAGTCCTTCCATTATAGATTAAATCCTTCAAAGTCAAGAGTATAGATAGTGTATGTTGAATACTTTTTATACTCATATCTA
TCTGCAATTCTAAATACACTTCCAGCTGGTATCATTACTTCTTGTTCATCTGAAACTAATTCCATATTACGATAACGATGGCTATCCGGAAACTTAA
AGTTTGGATTGTATTCTTTACAGCGTAGAGCTTTTATAGCATACTCCTGGAAATTGAATACCATAGGAGCTTTGAATTCAAAAATAACCTGTGTGTT
ATACTCTAAACCGGAAGCAAAATGTATAGCTATATTTTTATCATATGAAGCTGATACGACTTTATCAAATGTAATAATATCAATTCCTTGATTTAAC
GCTTGCTTAGTCTCGACTGGAACACCTCTCCAAAGAGGTTTATCGTTTGGAACCAAACGAGATTTGACTATTTCATTTAACCAAGAATGATCGTCTG
GTTTATTAGTAATACAATGAATTAAAAGTTCAATTTCAGATAAATTAAATCCTTCAGAAAGTAATTCTTCACGAATAGAAGCACGCACCGATGCATC
CATTGATTTTATTTTAAAATCTTTTAGTTGCATTACTGAGTATTTCATTCAACTACCTCAATATCATAAACTTTAAATGTTCCAAATGAATCGTGTA
ATTTTCTTTTGAAATAGAAGTTATTTTATACTTTCCAATTGGAATCATCCATTCTTGTTCACGTACAATCATCATTAAGTTATCAGTACGTTCTGA
ATCTAATCCATCAGTATCTTCATATGTATACTTAAATTCAGTATTAGGAGAAGAAAGTATATATCGCTGATATGGTCAGAATAATTAAAAGCTTTA
TCAGTTTTTAAGCGAAATATTATTTCAGTGAAATACTCAACATAAGAAAAACCACATGCTGTGCGCAAACTAGTAGTAAATGAATCTACTCTGTTCG
TTGAAAACACTTCTCCAACTTGTAAATCTTTAATGAGTTCTTTTGTCGATTTGATATACCACGATATAGCTGATAAGGCGATTTAGTTAAATGCTT
TTTAACTATTTTATTCAACTGCCGATGAAGAGCTTCATTCTTTTTGGCTTCCATCAACTGCCAAAGAACTGACTGTTCAAAGTCAGTAAATTTTTCA
CAGACCTTTTTGTACATATCATATTGAAAATCGACACTTTCAGCTTTTATAGATAACTGTTCAACATCTGCGAGATTAATAATCATGATAGCCTCCA
TATACTTTCAGAAGCTATCATATCATTGTTAGGAAGGAAAGTAAACAACTTTTTGAATTATTTTGCCCAGGCAGCCCAAGGCGGAGGGTCAAGATGGT
ATGAAGCTAGTTCTTCTAGAAGAGCATCTGGGGCTTCAATTCCATAATTCTGTAATACTATACGGTACTCTTTCTTATAATCACTAGAATCATTCTG
GATATTCGTAGAATGATTATCTTCTAACATCTCAAATAAATCCATATTAATTCCTAGCGATAAAAACCAAAATAACGATTAGCTTCAATAATCTTTC
TTTCTTCTTCAGATATTCTCCAGCGTAGTCCAACATCAAAATGAGCCCAGACCATCTTAACAAATGCATTTATATCTTTAATATCTTCAATAATGAA
TGTTTTACTTTTAGAAGGTTGACCTGCTAAATTAAGTGCTAATTTAACTTTATCGTCTTCAAACAGGGCAAAAAGACCATATTCATGAGCTCTTTTA
TAGCCTTTAATAGTTAAAGCTTCAGAAGAAGAAAACGGTGAATCAGTATTCTGTAAAATATCTTCAGTATGCTTTATAATTAGAATAACATTTTCTG
GATATTTTCTTTCTTTTATATCTTTAATTAAAAGATCCGGATTTTCTGCTAAAGGAATAATTAATGAGCATTTTTTATCAAGTGCATTTACTGATTT
ACCTTCTTTAGACATAAAATTCTATTGAATAATGTTTTGCTACTTCAATCATGCGATTTCCTCTTGCCTACTAATGGACCGTCAGGAATTTGTTTTC
CTGGATATATTTCTCATTTTCTTCACAATCATTTTACTGCCAATTTTAAGAAGCAAATCCATTGCTCATTTGCTTTAGCTTTAGCCTCTTCTAATATC
ATATCTCTGTTCACGATTTATCCCCATAGATGTCTCTCATTAATTTAAGCGCTGAGCGTTCTAATTTCTTTTCTTTCTCAACACTAATCATTGATTT
CATCCATTCTTCCGATTCGTTCTGCATTTCTTTATTTGCTTGTTCAACCCAACCATCATCAATATACATCGAGTTTGGTCTATTGAACCATTCAAGC
ATCTTCTTCAGAGCTTTCATTTGTTTTACCTAAAACAATAGTAGGAGCATCATCAAATTCATGAATTTTTAGCAAATTTGGATGTAAACTATTCCAT
ACAGAAGAAATAAAGTATGATAACGCATCTTCACTTGCAATTATAAATTTATTTCCTTTATCTATTTTCCAACTATATAGTGAATCGTACGAATAAA
AAGATAAAGGCTTATCATTATATTGTTCTGCGCTAACATTAATGTATTCGGATTTAGTAAATGCTTCAATTGCTCTAAATGGAATATTTGGTACAGT
TTCAATAATACCAATCTTTTTAAGTTTTATTTCAGCCATCTTCTGGAACTGGCATTGAAACGAAATTTTCTACGAGATACATTGGGTCACAATAACTC
TTATCAATCATTACTGCTACGGTAATTGGAACGTCTTTAGCAAACGACATACTAATACTATTGATAGACATTTCAAACAAAATCGCTTCCATAATTT
TCCTCAATCACAAGATGTAGATGAACAACTAGAATCACAAGAACTTTCACATGAATCGCCCGTCCATACATGAACAGGAACATTAGTATCATATGAA
TCAGAACTAGACTGTGTATTCTGTGCATTAGATGATGTAGTAGGTACTGACCAGCGCCAAGGATTTTTATAATATTCTTGGGCTTCTTCATAAGTCA
TAGTAACTGCTTCTACTGTTCCATCTCCCATATAAACATACTCAACTACAGTTAAAGGAAGGTAGTCATTTGAAATAGGAACTACACCTTCTCCGGG
AGTTGTAGAGAAAAAATCCGTAAAGAAACTTTTAAACCAATTAAAGATAACAATTACAAAAAGCCTCTTTTGAATTTAGCTTCTTCGCCATAAT
CATATCGAATCTCTGCATTAAATTCAACAGAACCATCTGCGTACATCATAAATGAATGCACAACAACTTCTGTAGACCATGGCTGTAGTTCATATTT
CTTCATTACATGCCGTGAAATGATAATATCTAAATCTTCATTTGGTTTAATCCAGCGATTTAACATAGTGCTCTCCTCTATAAGATAATTCTATTAT
ACCATACTCATTTTGGAAAGTAAACCGGTAAAATGAAAAAAGGACTCCCGAAGGAGTCCTTGAATTATTAACCACCTATTTCTGTAGGCGTAAACAT
TGCAGCATTCTTAGTTTTCCAAGTTGTTGCATCGGAAACTACATCAGAATAAGCTGCTTTTTCTGACGGAAAGATTTGATAATGAGAATCTGCAATA
CGGTGTTCATTTGAATATACATCAAATGCTACAGAAACTTCCATACCTTTAACTTCTTTGCCTTCACCTGCTGGATGAGTAAAGGTCTTGATGTTAA
CGAAACCACCCATAATAAACCTCCTTTATTGTTTAATTACAGGTGTATTTATATCAGTCTTCAATGAAAACTTGTGCCAGGAATTCGTGTTCATCTTG
AATTTGTTTATATAAAGCCATTACAGCATTTATATTAGAGCTATCTACTTTAAGTTGATAGGCATACCACTCGTATAAATTAATTAAAGCTTTTTGT
CGTCTAATAAATTCTTCTTTGGATATTTTCATTTGAATGCTCTATAATTAATTTTAAGGCTTCTTTACTGACAAAAATTTCATCAAGACCTTCTTC
TACACCCCAATCAACTACACGAAGCTGATTAGATAAGAGCTCGTATGTGAGCTCCTTGTCATAATTTTTAAATAGCTGGTCAATACGTTTCTTGTGG
GCTTTCTTAAGCTGGCGTTTATTTAAACGAGCCATTAATAACCTCGGTCTTGACGAGCGAAGTTTTCAGCATTTTTCAGATAATAAAGTTTAAAGAT
TTCTTCAGCCGTAAGACCGAGGCCTTGGAACATGTTCAGAACGAAATGAAGAATATCAATCATTTCGAATTTAATTTCCAACTGGTCTTGTGGAGAC
```

Figure 13(I)

```
AAATCAGTAATCAGAGTTTCACGTCGTTCACCATGTTGAGCTTTCCAAGGCTTCCATACAGCAGATGCATCTTTTTCACCATTGCTCATACCACCAA
GAGAAGTCAATAGTTCGCGGAATTCATCATCAATATAATCTTTCTGATTACGCAGCCAATCAACAACTTCACCCGCAGTAGCCAAATCATCAGGATG
ACGGTTATATTCAGGTTTATCTTTAGCTAAACGAACCTGCAGAGATTTCTGCATATCAAGCATAACTTGCAACGGGTCTTTTTCATCACCGAGAATA
TCCCAGTATTCATTTTGAGCTTTATCAGCGCCTTCAATCAGTTGTGAACATTCATTAAAGTATGCCATTATTTTTCCTTTCAATTCATGGGTTAGTA
GATTAATTATACAATAAATATATAAAGCAATAAGGAGGACATATGGTACAAAAATTAATGGCACTTGTTAATGCCATCAAAGGTAATAAAAAGCGTA
TAGCTTTTACTATTTCTGCTATGGTAGGAATTTTACTCTGGAACTTTATTTTATCACCTGTTGCAATTGCACATGGTATTAATATTCCAGTAGTTAC
TCTTGATACATTCGTAGATTTAGCATTCGCTTTAGTTGGGTTAATTTAAATCTTAGCATATTTAGATAACCGCATTTTAGCCATCAACCCCTGAGCA
ATATTATTTTTCATATATTCCATAATTTGTTCAGTGGTTGCACCTTCCTTTCTAATCATATCATTAACATCTTTTGATTTCCAGGGAGATTTATCCC
AAAACATAACCCTTTCTCCTGCATCAACTAATTTAGTCATTCGCTTAATAGTGTCAGGATGACGAGGTTCATTATCTAAAACCCACACACGTCTATC
TTTAAATGGAACAACTTCTAGGTCTAATTGACCACCTGTAATAGCTATACCATTTTCAATAAAAAGCGAATCTATAGGTCCTTCTAGAACATATACA
TCACCATCTTTGACTCGTTCGACTCCATAGATTTTTGTTGCCTCAGGATAAGCTTTGATGGTGATATATTTTTGAGGAGCATCTTTCTTTAATGCAC
GTCCTTGAAAAGACTCAGCTTTTCCGTTAGCATTATAAATTGGAATAACAAGACGAGGCTCAGGTGTTTCCTTTTTATATGTTCCTGGAGCTATACT
ATTAACTAATTTAGGCCATTCAGTTGTAAACCAAAGATATTTCCATTTATCCTTTGGAATACAACGAGCTTTTACATATTTTATAATTGGATGGTCT
TCCGCCAATTTATCTAATCTGATGCATGACGGAAGAGATTTAATTATTTTCTTCTCAGGTTGTTTAGGAAGTTCTTTAGGTTTTTCTACTGGACGAC
TTTTACCTTTTCTTTTCTTATTTCAAAGATATACTCACGATATAAATCAGGTTCAAACTCCTTTAAATATATTCCGATTGGTGCATGATAGTTACA
GTTATAACAATGAATATTTCCTTCATTATTATCGCCATAATACCATCCACGGGCTTTATTTTGATCGGTTTTTGAATCTCCACAAACGGGACATCTA
AACCGTAATTTAAAAGTTGAACTATTATTTACTTGTGCGAATTTAGGTAAATGAGCCAATGCACGGTATGCAAACTCATTATCAATCCAAGGTATTG
ATGACATTTTTACTCTTCTTTTTCTTTAGATTCCTCTTTCTTCTTTTTAGGAATCTGTTCAGGACCCTTTATTTACTACAGCGCCTGACGTTGTTCCA
GTAGAGATATTTTCAGGATTACCACCTGAATCTCCAGCTACCATATCTTCTTTAATAAATTCTTTATATGTTTTCATATTAACCTCTATTCATAAAA
GCATTAAAAATTTGGTCATCAATAGATGGCACAGTAATATTTTCTGCATCATTTAGCAAATCATTAATTTCATCAGATAGCATAACACATGTGCCTT
TATTTCCTGTAATTGTTACTGCACAATTACGAACGTTTTCTTTATCAAATTTTAGGTTAATATTTTCGTAGTGAAAATCCTTTAATGCCGAATATAT
CTTTAAAATGAAATTGTCTTTTACTACAATAAACCCAACCTCACTATTAAAACGTGGTTCATGGAAACTGTAATAAACCTTTTCATCTATAAAATCG
TATGAAATTTTTTCCATTTTTAAATATGAAAATTCAGAACTATACATATTAACCTTTATTCATAAAAGCATTAAAAATTTGATCGTCAATAGAAACA
TTTACTTTAGACTGTTTTTCTGATGGTAATTCATATCCACATATTACAATTTTGTGATCAATATCAAAATACACAGAAGCAATATGATTAATGATGT
TTTCAGTAAAGTCTAAATCAACATCAATATCTTTTTGACCACAGCCCAAAGGATAAATAATGCGAGTAATTCGATTATCTTTAACAAATATTCCACC
GACATACTCTGTGCTGCGTTTAAAGTTTACACGTTTCTCTAAATGAAAAATATTCATAATATCCGCTTCAATTTGAGTTTCAACTTCAGTCTGATCTG
CAGTCATAGACCATTCACACAAGTCTTTATCATATCCTGCCATAGCAGGCTGAGCAGCACAAGAAGCCAAAGTAAAAATTGTAGCAAAAATAAATTT
TTTCATGATAATCTCCTCAGTAGTTTATGTTTATATAGTATCTCAATTTCCAACAAAAGTAAACAGCTATTTTAAAACTTCTGCATAATCACATGTT
ACAAACTGTTTCTCTAGCTTAACGATTTTACGAAAATACCTTTTATACTGACGAATCTGCCTCTTCGTAGGACGTACAGCAAACTTAATAAATTCCA
CTCGACCAAATGGAGGACTTTCTTCTGCTGGAATATCTAACACCAATTCCCACGTATCCGCAATAAGTGCTTTGAATTGCGTATTTTTCCTGACGTT
ATACGGAGTAGGTTTAAATAAAACAATATGCATATTATCCTCGGTAATCTACTTCACATACTTTCTTGTCATCAATGAAAGCTTTAACTAGTGCTTT
ATTAACTTCAGCATATTGAGTAGTAGCCCATTGAACGTCATCTTTCATCATTGTGGTTTCTTTAGTAAACATGCTTTCATTCTTAAACCACCCCATA
AAAACTACCTTTACCAATTCCATAACAATCTCCTCATTTAACCAACAAGACTACTATACCATAGTCTTGTCAGCTTGTAAACTAAAATTTTAATTCA
TTTGCCAAAGCATCTAACTGAGCTCGAGTCGATTCGTTTCTTTGATAGCGATTCTGCTCAGCTTGTATCTGTTGTGAACCTGCTACCTCACTCACTT
CAGTTGGAGTAGAATCTTGTTCAATTTCTACCCATTTCTGATTTCCTTTTTGAACACCCATCAAAAACTTATTCCATTTATTCTTATCACCATATCG
TGATTTGATTTGCTTAATAAGTTGTTGTTCAGCAGCTGCTAACTCCTCGGTTTCAATGACCGCAAGCATAAAATCAGCTGTTGCTGGAAGACCGGCA
GATTCTGCAATATCGCTCATGTTAACATCAGAAGAATCCCAAGCTTGTTTACCAACCTGTGCTGCAGTCCAAAGAACAGTTTCGGTTTCAACAGCAA
GAGCACGTAATTCCTCTGCCAATGGCTTTAACAGTTGTGTAACTATTTTCTGAGTAAACTCTAATGCGGCAAGATTTACAAATACCCAGATAGTCGAC
AATAATGATTGTTGGAACAAAATTCTTCTTGAGCTTTAATTCGTTTAAAAGCGATCGAAATGTATTAGCATCTGCTCACCAGTAGGATACTGTTTA
ACGATTAAACGACCGAGAGTAGATTTCTCACGCCATTTTTCCATTTTTCCTTTATACTCAGCGTAAGAAATATGCCCATCATCAATGTCATCAAGAG
AAACATCAAGCATATTAGCATCAATACGTTTAGCGCAGACTTCTTCTGCCATTTCCATGGAAATGTAAAGAACATTATGTCCGAGCTGTAAATAATC
TGCTGCCAATGAACACAGACCTAATGACTTACCAACGTTAACGCCAGCCATTAAAACGTTCAGCGTTCCAGTTTCAGCTCCGCCTTTAGTAATTTTG
TTTAGAATTCTGAGTTAAATGGAACCTTACGAGCTTTATTCATATAAGATAGCCAACGTGCTTCGTAGTCATCCATCCAATCATGACCAACGTAAC
TATCAAATGAAATTGATAATGCTTGGCGCATGATGTCAGGAATAGCACCAACATCCGGCATTTTCTTATTTCGTTTTTCCGGAGGAAGCTCAGCATT
AGTTTGAATTTCAATTATTTTAGATGTGGCGTTAAACATCGCCCTTTGCTGAACATATTTTTCTGTTTCTTTTACTAACCAGCTGTGGTCTTCCGGA
GAATCAGCCAGTTTTGAAATAAGTGTTTTTACACCAGAATATTCTGTTTCAGTAAATGAACTATTTTCTAATGCAACATTTAACGCATTAATAGATG
GAACGCTATGATACTCGTTGACATGAGATTTAATTAATTTGAATGTATTTTTAGCTGGACCACTTTCAAAATATTCTGAATCCATATATGGCCAAAC
TTTTGAAAAATAAGCTTGATCAAATATAAGATGAGAAAGAATAATTTCTACCACACTTACTCCTTAAAAGAATTTAAACTTTTTCTTTGACCTTTTA
TTAAATGCATCTTGTAGTTGCATTGTAATACATTTTTCTACATGAGGAGCTAACTCAGCTTTTCTTTCTTGGTCAAGAACAGCAAAGTCCATTACAA
CCTTTCCATCAACCCAATCCAGTTTAGTTACATACACTATATGTGTAGAACCATCTTCTAGTTTAATGACAATCTCCTGGATAACATTTTCCATAGC
GGATTTAATTATCTTAAAGGACATTCATTAAAAAGACGTTCTTTTCTTCTTCCCCCCTCCGAAGAGGGGGATTCATCGATAATTTCTAGATCTAAA
TCTAAATCATCTTTATTCATTAAATTCTTCCATATCACTTAACTGCTCGAGGTCAGTTTCTAAATCAGCAGCTGATTTACTTTTACTTTCTGGAGAT
TTAAATTTTTCAACCTTTGAGTTAATCAATTCATCGACTTCAGCTTCAACAATTTCATTACTATCAATAGCACCTAACTGATAAGCACGTTTAATAG
CATCTCGGAATGGTTGATGCTTAAATAAAGGACCCCAGAATGTAGTGCAGTTGGTATCTTTTGCACGCCAAGATTTTCTTCGCGAATCATCTCACC
GGTTTCTTCGTCAAGAAATTCACGAGCATACCAGCCATTTTTAGGTTTTACCACAAATCCTAATTCAAGAGCCATATCTAACAATCCAGAATAAGGA
TCGATGCCACCGTCAAATTTAACATCAATAAAAGAATTTACTTTTTTCTTTAACGGTACGAGATTTTTCTACATTTAGAACAAATTGATACCCCTGAA
GATCAGAACCATCTTTAATCTGGCGCTTACCGATAATGAATACAGTATCAGCCGAATACATTACGCCTGTACCACCCTGTCATCACGGTTTACTAAA
CATTTCAATTGTTTCAATTGTATGGTTAACCGCAACACATGGAATATTTTAATGCTAAAGTAAGGAGTAACAATACGGAATAATGACTTCAGTGAT
TTAGCACGAGTCATATCTGCCACAGATTTTTCATTCAAGGCATCTTCCGTTTCTTCTTAGAAGCCATATTACCGATTGAGTCGATGAATACAATAA
CCTTTTCACCACGCTCAATAGCTTCAAGCTGGTTCACCATATCAATTTTCAGTTGTTCAACTGACTGAATTGGCGTATGAATTACACGTTCCGGGTC
AACTCCCATGGATCGCAAATAAGCTGGAGTAATACCAAATTCGCTATCATAGAATAGACAAACCGCGTCAGGATATTTGTTCAAATATGCCGCAACC
```

Figure 13(J)

```
ATAGTCAAAGACATATTTGATTTAAAGTGTTTAGAAGGCCCTGCGAAAATAGTTAAACCAGACTGCATACCGCCATCAATTGCACCAGAAATAGCAA
TATTAAGCATTGGGATTTTGTACGGATTACATCCTTTTCATTAAAGAATTTAGATGTAGTCAGTTCAGCAGTCATTTTAGAAGTGGAAGCTTTAAT
CAAACGGGATTTTAAATCTGCAATAGACATTCATTTTTTCCATAGGCATCATTATATTTTCCTCACTGGTTAAAGATAGAGTAATTATAACACAATA
AATTTAGGCATTAATCAACTGCTATTGGATGAATAGCATTAAACTTATGAAATGCTTCTGATTTTTCTTTGCGCGAAACACACATGCGAAGAACCTT
TAATGGCTCGTCTTCTTCACCCAACGATTTTCGTTTTTCAATATTAGAAGTTTTCCAACGAGCTTGCTCTGGAAACTCTCTATTGATTTGCTCAAGA
GCTCTATTATGTTTTGAATTACTACGAATTGAACTGCACCCGCCCGGAGCCTGTGCTTTTCCAGATACAACCAGATATTTGAACAAGGCCAAATGCG
GATAACCTTGATTAATTAAATTGAGAAATGCATACATATCTTCGCATAAATCAATTTTTCCATACCCAATTTGTTCTGTTGTAAGTTTTCCAAGGTC
ATACCAAGTATTCGTGAATCCATATGAATTTTCACGATAATTACCCCAAGATGAAGTAATTTTAAAAATAGGTAGACGAGCATGGCCATGATAATAA
CCGCAATCCATGGCATCTTTAACGTATTGAATCAATTCATAGAACTGTTCACGAGTTAATTGATTAATTTTATCTACACAGCGACGATCATCTTTCT
TTCGCATTGAACTCATACGAATAGTAGTATCATCATCAATCATCCAAATTCGTTGACCTGCATACATATCAGTAATTGCTTTACGAGTACCAGCAAT
TCCGTTAACATCATCAGGAATAGTTATAATTTTAGCTCTAGACCCGTAAGCGTCATAATAAGCTTTTTCTTCGTGTTCACGTACTACAATATGCGGT
TCATAATCAGATGGAAACATATCAAGGGCAGAAACTGCCCCTACGCGTTGATAGCTTGGAATTACGAATTGAATCATTTCCACTCACCGTTATAATC
TTTTTTCGCAATATGTGTTTCACCAGTTTTCCACCAATGGTCAACCAAATAAAAATGACGGGAATACACATGAAGGCTCCCGACATTCCATATAATG
GAACCTGCTTTATACTGACGAGTTGAATCACCTGCATTCAAATCAGATACTAATTTATCTAATACGTATTTTTGCCATGCATAATCATTACGGAATC
CGAAGACCACGTCATTTGAACGCATGCTTACTACTGCATTGACTTTCTTATCACGAATCAGGTACTGTACTGTATTCGTACACATGAAATCTGACAT
ACCATCTTTATTGTAGTCAAATTGCATGGATGGACGAGTATAAATCATGATACCACGTCGAGAATCAGGATTTTGACCAAGTTCAGCTAAACACATA
TCATACTGGGCATAGTTATCTTCTGACCAGATAGCCCAACCATAATTCGAGTTAATTTCGCCTTTAGAAGATGCTACCTGCTGCCAAATCTTTGGTG
TTTCACCTGGAATATCTTTAACAAACAAGCTCTTAGATTTATACCATTCAAGTTCACGCTGAATGTATTCATCATTAAGAGCGCCAAAAATAAACGG
TTCATCTGCTACAAATGATGCGCCAATAATTTCAATAGTTTTAACACCAGTTTTATCAACTACGAAATCTTTTTCTTTTAATGCAAGCCCCAAATGA
AGACGGATTTCTTCAACTGTCATAGAGTCACTAATCATTTAAACCTCAATTGATACATTCATATTTAACTTGTAACAGTAATAAACCCCAACCTAAA
ATAATAGTTGGAATCATAAGAGGGAACCGTTACACTATAGTATATACTTATTATAATCATCAAGATTAAAAGCAACACTGCTATAATTTTGCTTTTCA
TTCCTTCTCTCTGATGATAATTACCTGATTTGGTTGTGCAGACTTTTTAGTTTCACCCGCAATTGACCAAATAAATGTAATAAACCAACCAATAATT
GACCAGTTAAACAGTAAAGACGTGAAAAAGATTCCTACTGTTGATTTTGACCCACGCATCAAGGCGATGAACCATGGAAGCATGTATATAATAATAG
CCAACACACCTGAAACTAAAACCATAAAAATTGAACCTGCTACTAAAGTTTCCATGTTTTCCTCACTTAGTCAAATTTTTTACACATGAATTATAAG
AATTCACTACATACTCCATCGGAGCATTTTTACCAGTACGCCATTGGTAATTATTAGCCCAATTAGCCCAAATTTCGGCGCAGTAGTTTTCAATTTT
TTCTTCGCGTGTAATTACATCAGAATTACGATATGCTTGAGCAGATTCATCTGCAGCGAATAGCTTCGTCAAAATTTGCCTGCCATTTGTTCTACTGTT
TGCTTTGGAGCTTCTTTATAACACTTGACATTAGGATTATAAAACTTGCTTGAACAGTTTACAATTTTTCCTACATCAGACTGATTTACTACCGGTC
CTTGAGCTACACAACCAGTAAGACCTAATGCAATAACCAAAATAGCGATTTTCATAATAATTTCCTCAAATGCAAGTAGTAATTACTCCAGTAGTGC
TTATGCAGGTATTACCCATTTGCACACCTAAAGATCCATTTGTATTCACATGAAGATTATCATCAATTTTAACTGATATTTTACCATTAGTGTGAAT
AACGGTGCTAGATTTAATCACAGGTTGAGTATCATTTTCAACACTAACAAATGGAACTGCTACTAATGCAACTAAACAAACTGCTAAGCATCCCATA
ACAATTTTCATTTTATTCTCCAAATCTGTATCAGTAGTTGATAGTTGTATAGTACCACAGAGGAACAGTCTTGTAAACAGTTTTGTGAAAATTTTTT
AGGGAATTCTAAAGGTCCAAAATCATCTGTTTTTCATAAGTATAGATTTATATTACTTGTATGAAAAAGGGACCCGGAGGTCCCTAGATTTATTCTA
TCAGCCAAACAGGAAGTCTAACGAAGCTTTTTCTTCATAGTCCATACCAGCCGATTCACACATGCCCGCAAGCGGTTTAACAAACGATTTTTGGAAC
AAAGTTGAGTAGTCAATCCAAGACAGTACGTCAGAACGAATTCTTTTGGAAGTTCTGTACCCGACGGCCAAGCAATGCATTTGTCACCAAATGGAT
TTCCTTCACGCAATGGAAGAACCATTACTTTATTTCCATCCAAAATTGGAGCTACACCTAAACCGCTAACAGCTCGACGATAAGTTAGCACACCACG
AATATGGAACGGGCATTTAAATCCTGGCCAACCTTTATCATCATATTTCGCTATATCGTTCGCAGTTTTTACTTCAGCAATAACTTTATAGTCAAGT
TGACGATATTCTTTCTCGAAGTTCTTGTAATATTCTTGGACAGACTCTTCACCTTCTTGAAGAATACGACGAATACTTTCTTCGAGAGCTTCTTGTA
CTGCTTTTGGTGTTGAACTCTGCTGAGTTCCATACCCATGATTTTTAGATGTGGTTCAGCAAATCGCTTATCTTCCATATCATAAACGTTCAGAGC
ATAACGTTTTTTCGCTTTCCAAAATCCACCAACACCCTTTGAACCAAGCGGAGGACAAGAAATAGCTTCACGGTCCATATGCATCAGATGCTCGCGA
TTATTCATATAATCACATAACTCACGATATGCAACATCAATCATAGGTTCCATCTTTTTCTTACCGAACTGATTCATGAATTCAACTAAATCATTTT
GTTCTTTAAAGCCGTCAAGACCTACTTTTTCAATAACTTTATCTACACAAACATATACCGAATCAGTATCACCTGCTGCGATGAAATCTTCACCATT
AGTTCCACATACTTTATTNAGATATTCATTAATTTTACGAGCAATCCACTGAATACCAACTTGGCCGAAAATTGTGATAGCAGTAGCATTTCGCAAA
TCATAGTAACGAAAATGATATTACCAAGAGCACCGTAAAGACTGTTAATAAGAATTTTACGGTTCAGCTGATTTGTGTTAGCAAGTGTAGCTGCTT
TTTCACATTCTTCAATCAAACTATTGAGAACAGATTCGGTGTAATTCGATAGTTCATTTAAGAAATCATCACTGAACTTAACATATCGTTCAACTTC
AGGTTTAGTTGAACAAGACCCTGCGCCTTTCATAATAATCTTTTTAATAGCTTCGGCATTCATTTCTTCAGCGAACATTTTCTTTTTCCAATCTTTA
CGCTGGAAAAATACTTTAGCGATTTCCTTTGGAATGATACCTTCTTGATGCTTATCATACATCCATCCATTCGGGAGAACAAGAATATTCATCACTCG
GTTTAGGAGCTGTTCCTGCAATATATTCATGAATTGGATGAACTTTAAACTGCCCACGAATAGTCTCAGGACTAATGTTAACCTGACGAATAATGCT
CGGATACAGAGACGTCAAGTCAAAACTCATAATATATCGACGAGCAATTGGTTTAGGTTCAAACACAAATGCACCCGGAAAACTCTGTTTAACGTGC
GAACCCTGTTGAGGAATAACCTTATGTTCACCTTTCAATGAGTTAAAAATAATGGCATCCCAGGTTTTAATAGGACTCATTACACCAGAAAAGGCA
TTTTAGCGTAATAAGACATACTTAAAACTAGATCGATAAACCCGCGAATTTTATCAATTGCTTGAACTGATTCTACGTCAATGATGTTATAACTAAT
GTATCGTTGATGATTAGTCTCACGAAGTTTATTAATAGGACCGTCGTATGGTAATTTACCTTTTTTGGTTTCATGCTGAGCAACTGATTCCAAAGAG
AATGACGGCAAATTAGTAAATGCGAATTTCTTATACAAATCTAAATAATCAAGAATAGATACGCCATCAATAGAATAAATTTCTTTGCTACCGTACA
TATTTTGGATAAGTTTAGATTTTACTCGACCGATTGGAGAGAAGCGTTTCATACTACGTTCACCGAGAACCATTTTAACGCGATTCATGATATACGG
AACGTCAAATCCCTCAATATTCCAACCAGTAAAAATAGCAGGTCGTTTCTGTTCCCAAAGATTAATATATTCCATGAGCATATCACGCTCATTATCA
AATGGCATATAAATTACTCGGTCAGATTTCTTGAGGAACTTCTTAGCATCCACCCTTCTTTGCATCCCATTTTGATA
CTGAACCATACATTGAATTCAAAAGGTCGAAAACATAAAACGATCGTCAATTGAATCATAATGAGTGATAGCATCAATTTCATATTCTGCTTTCAT
TGGGTCAGGAAATTTATCACCAGTAACCTCAATGTCACAGTTAGCTACACGAACAAATTTTCGGTCATAAACAATTTCTGAACCATATGTATCACTG
ATATAAGCGAGTTTAAAATCGTTCATACCGAGAGCTTCGAGACCGATGTCTTCCATTCTCTTCATCCAATCTCGAGCATCTTTCATTGATGGAAATT
TTTGAGGAGCGCAGTTTTTACCATAGATGTCTTTGTACTTTGACTCTTCCTTACAATGCCTAAACATAGTTGGAAGATATTCTACTTCACGAGTACG
TTCCTTTCCGTTTTCATCAATATAACGTTCAACAATGTTATTTCCGACTGTTTCGATAGAGATATAAAATTCTTTCATAGATATTCCTTAGTTTATA
GCCCGAGTTATTAGGCTCTTGATATATTATACTCCAAATAAGGGGCCGAAGCCCCTTGCTTAATTACCAATCGTATATTTAGGAACGAGTTTCCATT
CATGTTTTTGTTTAAAAGAAATAACTCGGAAGTTATTAGTTAAATCTTTCATAAAAGTTCTTTGACCAGGGACGATTTCAATCAGTCCCCAATCTTC
TAACAGCCATGCAATCGAATCACGACGAACTTCATCTTCTTCTGTCATTTCAACTTGACGGCCATCCATACGAAGCATTTCTTTAAAATGAACGATA
TAGTATAGTCCTTTTTCTGAAGAATATGACAGGACTGATACAGAACTTTATCTTTATTATTAGCAATTCCCATACGAGTCAAAGTTTCTTTTACTT
TCAGAAAATCTTCAGGTTTTTTAAGAGTAATTTCAATCATTTTACCATTCCAATGCTAGTTTTTTGAGTTGTTTCTGTTCTTTTACGTTCTTAGTCA
CTTCTTTCCAAAAAAATCATCCGTGACTAATCCTTTAAGTTCTTTTAATACTAAAGGTAGTTTTCCATTTTTAGTAAGAATTGATTTATAGTTAATTGC
```

Figure 13(K)

```
ATCATTTGTATTAACTTGATACCGCTTAGCAAGTAACTTAATAATCAATACTTCGGTGGAATCTTCAACTAGTTTTGCCCCATTTACCATATCTTTTA
CCCCGAGGAACTGCAGCCATTAGATAATTAAAATGAGCTTCATCACTTAATCCAGAACCGATTAAATTCATAGCATATACAGCTGGCATGCACTCTG
GAAATTTTGATAATGCATTTTCAACCATGAATTTTGAATAATCTTTTTGAGCAATAGAGCATTTAGTTTTATTATTAATAGCTCCAATTATTTCAAA
AAACTCATTTTCAGCTTTTTCTTTAAAAGAATCAGCAGCGGATTGGACAGCTGTCCAATCTTTTGAATACCAAGCAACTTGATGCTCGTTTAATTGA
ATATCATCTTCAAATAAGCTCATATCACTTCCACTGCATTTCACATGCTAACTGAATGAAAAGATAAGCTAAATGCAATTCAGTATTAGCTGCAATA
CCATGATACTGATTATTTTCGCCGACAATTTCGTACATACGAATAATACTCTGTGGAGTTACACGTGAATAGATTTCTTCGGCAAGTTTACCAACAA
ACCAAGAATAATCGGCTGCATATTTTGGTGCTAAAGCTCTGAGTTGTTTAACATCTTTATTTTTGAGAGACTCAAGAACATCATCAATAGCACCACG
ATCGTTAGTAACCAGTGATAAAATACCAGCATCCAAAACACCTTTAGATGAATAACTATCGAGCTCGCCAATAGTTTTACGAAAATCAGGAAAATTC
TTTTTAACCAAAGCTGCTACAACTTTCATATCAGCTATAGCAATTCCTTCATGCTTGCAGATTTCAGTTAATCGACGAATCATCTGCTTCATCATTT
CAATTTTATCTTCATCAGTTGGTTGACCGAATGTAATAACTCGACAGCGTGACTGAAGCGGTTTAATAATACCATCAATATTGTTAGCAGTAATAAT
AATACTACAGTTTGAGCTATAAGCTTCCATAAAGGAACGAAGATGTCGCTGAGACTCTGCTAACCCTGAGCGGTCAAATTCATCAATAACGATTACT
TTTTGACGACCATCAAATGAAGCGGCGCTGGCAAAATTAGTCAAAGGACCACGAACGAAATCAATTTTACAATCTGATCCATTCACAAACATCATAT
CAGCATTTACATCATGACACAATGCTTTTGCTACAGTTGTTTTACCTGTTCCTGGAGAAGGAGAATGAAGAATAATATGTGGAATCTTACCTTTACT
TGTAATAGATTTAAAGGTTTTTTTATCAAAGGCGGGAAGAATACATTCATCGATAGTAGATGGACGATATTTCTGTTCAAGAATGTGTTCTTTTTCA
TTTACGGTAATCATAATTTCCTCATTCAAGTTTTAGTGTAAATTTAAGGGCCGAAGCCCTTTATTAAAAATCGTGGGTAGAATCAGCTTCAAGAGCT
ACCACATAATTCGCGTGTTCACCTTCAAATTTAGCAGCACCTTGTTTACCTTTTGCCCAGAGCAGAAGTTTATAATTTCCTGGTTGCATTTTCATAT
TTGCCATATTGATAATGAAATTAAATGTATTTTCACCATCATAATCACCAAGAGTCAAAGAATATTTAACACGGGTCAAAGCAGAATCTTCTACTTT
ATTAAAACCGTTAATTACGATTTTACCTTCTTTTACCGTGATAGCAATTGTATCAATTTGCAGACCACGAGATACACGCAACAGTTGTTGAAGGTCT
TCAGCTTTAATTTCAGTAACAACAGATGCTACCGGGAATGGAATTGGTTTATTAGGAGCAACTACTGTACTCGGATCGGCTGCTGGCCAAAAAATTG
TTGAGCGTGCATCAGCAATTTTAATATTTCCATCTTCTGACTGGGAAATTTCTGCATCATCATTAACTAGAGACAGAATACCGAGAAAACCGTTCAA
ATCGTAAATTGCTACATCAAAATCAATAACGTCAGAAATATTTGCTTCCGCATAAGTTGTACCATTAACTGCACGAGTCATAATAAATGACCGGAT
TTAAGCATAATACCGGAGTTAATAGTAGCGAAATTTTTCAGCAGAGCAGTAGTATCTTTAGACAGTTTCATGTAATTTCCTTCAATTCAAATGAGAT
TTAATTTTATAACTAATTTAATAAAGCAATTAACGATTAAAATCAGCCAATTGTTTCAGCAACAATTTGAGCAGCAACAATTAGGCGTTCATCTG
CATTACCGCAATATTCATCTTCAAGGCGTTCACCACATGAAGTCATAATAAATTTAGCACCGGCGTTTAGGGATTCTGCAGTATGTTTGCGCATTAG
TTCAATCCATTTATTACTTACTTCACGATCGATAGCTTCATAATACGCATGACGAGCAGGTGCAGATTTAATTTTGTTCTGAATAACTTCCATTGCG
TTATCAGAAAGAGACAAAACCCATGCGCGACGAATTTTATTTTGGTTTTGTGGATTTGATTCAGAACGCACGTGTTTTGGCTGAATATCTTTTACAT
CAACAGTATAATTCACGGTAATTTTAGTCATAATACACCCTTTAGTCATAATAATCAGTAACAGTCCAAGCTTCATTTCTGTTGGACATTATTTTCGT
ATATTCTGATTTAAATGCATTCTTAAGCATAGATTCAGTAACTATATGCTTCATTAGAAAAATTATTTCTCAGAATATATCGTTTTATTTCAGGA
ATAGTTAATAGATGCTGTCCAGTTGAATATTCTGCCACAGTTCCTCCGTATAAATATGTTTATCACTCGCTGTATCAAAAGGATATGTTATGAATTA
TAAACTAATTTATGAAAAGTTAATCTCTAATGCTAAATCTCGAAAACTTGATTGCTATACTGAATCTCATCACATTATACCGCGCTGTTAAATGGA
AGTGATGATGCTTCAAACTTAGTAGATTTAACACCAGAGAGCACTATGTAGCTCATCAACTTTTAGTAAAAATTTATCCTTCTGAACCAAAATTAG
TCTATGCTGCTAACATGATGACAGTTTCTACGAAATACGCTAAACGCAACAATAAAACTTTCGGTTGGATTCGTCGTAAACTCTGGGAAATAGAAAA
GAACAAAGAATTCTCCCAGGAGACACGAAAGAAAATGTCTGATGCAGTAGCTGTAATAAAGCAAGACTAACTTGTCCTCATTGCGGTAAGTCTGGATTA
AGCGGGAATATGAATCGTTGGCATTTTGATAACTGCCCAAATCACCCTAATCCTAAAGTTAGACCACCAATGTCTAAAGAACACAGAAATAATATCT
CAAACGGGCTTAAAGCAATCGTTCTTGAAGAAACATCCTGCGAATTCTGCGGAATGATAGGCAAGAAATGCGTTATCGCAGCGCATAGAAATTTCTG
CAAGAAAATCCAAATGGACGCAAGAAAACTGAAAAGACTGGTACTTGCGTCCATTGCGGTAAAGTTACCACTTTCGGAAATTTATCAAGGTGGCAT
AATGATAACTGTAAATATAAACCTAGCTAATCTTAGCTAAACATAAATCTACCAACTTTTTCCATCTGAATATGCTGACCATATTCTTGTGGGTCATG
GTCTTTATGCGAAATTATGAAGAAGTTGGTATCCTTCAAACCATCTAAAATTTTAGCTACATTTTTAATGCCTTCAGCATCAAATGCACCATCATAC
ACTTCATCAAGAAATAAACAACTTATTTTAACACCTGAAACTTTTTCAGCAATATCACGCCAAGTAAATAAAAGAGCAATATCAATTCGTGCTTTTT
CACCTTGACTAAATGAAGCATAACTAAAATCTTCACGACCACGGGATTTAATTGTCTCATTAAATTCTTCATCTAATGTAAACACATAATCCGCTTC
CATTATTTTAAGATAATGGTTAATCTGCTTATTAAATAATGGAATGTACTTTTTAATAATAGCACCTTTAATACCAGAATCTTTGAGCATATCAGTC
AAAATTCCTCGGTGGTATTTTTCCATTACTAAATTAGTTTTTGTCTTAACAATTTTATCAAGTTCTTCTTGAAGCAATGCTATTTCATCAGCATGGT
CAATAAACTCAGAAGATGCTTTTTCTATAGCTGCTTTAACTTTTTAGCTTTATCTGTGATTAGAGATTGCTTTTTATTGCGAATATCATT
TGCCAACGACTGCTGGGTTTTAATATTATCTCGGTATTCATCAACAAGAACTTTTAAATTATCACGATGTGTTGAAAGCTGTTCAAACGAATGCGTA
CATTCAGAAACTTTATCTTTAATTTTAGAAACAACTTTATCACCGGAACTTAATTGTGACAAACAGGTTGGACATAATCCGGCCTTCGTGATACATAT
TAATGACTTTATTATACGAGTCAATTTTTGATTTAATTAAAACTGCTTCTTGACCGATTTTATTAAATGCATCAGTCGGGTCTTCATCTAAAACAAT
ATTAACTAATCTTTCATTAGCTTCTTCTATTTCCGATTTTAGCGTTCTAGCTTCTTTTGCCAAATCATCATACATATTTTGAAGACGAGTAAGGTTG
TCACCCGTTAATTTTTCTGGCGTTCAACGTTATCATTATATATTTAATTTGTTGGATAATACTATCTTTTTTAACATCAAGCACTTGGTTCTGCG
AATTTAATTCACGTATTAGTGCTTTATTAAGCTTATCCATTTCAGCTAATGTTCCTACCTCAAGCAGGTCTTCCACAAGCTTTCTTCGTCGCAGGGGT
CGACAAACCCATGAAAGGGGTATACCCTGCTGTACCAAGGACAACAATCTGCTTGAAACTGGCATATGACATTCGATAAGCTGTTCAAATTCTGCT
TGGAAATCTTTACTGCTGGCAGATTCATTAAGACGTGTACCATTAATGGTGATTTCGAAAACGTTTGGTTTTGTCCTCTTTTGATATAGTACTTTT
TCTCATCATATTCCATCCACAGTTCAACTAAAAGTTCTTTCTTATTTGTGCTGTTTATTAATTGACCTTTCTTTACATCACGAAATGGCTTGCCAAA
AAGCCCGAATGTGATGGCTTCTAACATAGTAGACTTACCACCGCCATTTCGTCCAGTAATAAGAGTTTTTGAACCTTATCTAATTGAATGTCAATA
GGATTTCCACCTACTGACATTATATTTTGATATCTAACTCGGTTTAGTTTAAAATTCTTCACAAAAGATTCCTTTTAATGTATCTTTTAGACCATTC
TATCATATCATCATAATCTAAAAAGTATTCATCAAATTCAGCCATGCAAACAACGCCTTGTGCTGTTTTTGATGTAATATAAATTATTCCAACATAT
CTAGAATCTTCTTCGGTATAATCAATATTTGCTATGAATTCATCATTAATGTCAAATGTCGAAAACTTCACAGTATGCATCCTTAATACAAGATACA
GCCATATCTCGTAATGATTTAGGTGTGTCATTATCTAAAATGTTGAAGTTAAAAGATACAGCCCAATCAGTGCAGACCGTGACCTTTTAATACAAT
TATCTTCAACCTCTAGCGGTTCAAACCAATATTCAATAATTTCTTTATGCCCAATCATCATCTTTTACTTCACATTCAAAATGCTGACTCATCATAC
ATTTTTAAATTCATCAAAAGTCATTGTGTTGCCTCTACATATAGCTGATTCGCATATTGAATAAGTGCTTCACGGTCAGAATCAGTGATGTCTGGAA
TTGCATTAATGTATTCTTCCATCAACGTCTGAAGAGATTGAACTTCAACTTCTTCACTGTCATCTGACTCGACAGAGTTATCAATCTTTGACACAAC
TCGTAATGAATGCACAACTTTCTCTAGTTCAGATTCGAACTTCGTCAGATTTTTGTCTACTTCAGTTACTATAACACGTACTGATAGATTTGTAAAA
TCTTTATAGTCAATTTTTCCTTTAAATGGATAATGAATTCTACGATGCCAGGTAGTATTGTTTGGAATAAATTCCATTCGTTCTGTTTCTGTATCAA
ACATCCAGAACCCACGAGGGTCATTCTCGTCACCGCAGTTAGTGTCCATGGTGTCCCAATATATCTGACATTAGCAGCCTCAGAAATAGTATGGAA
GTGACCGAGACCACACTTCTTTATAAGTCTTAAGGAAATCAGGTTCAAGACCGTGAGATTTCATTCCTTTATAAAAATAAAATCCATTCAGTTCCCAG
TGACCAACACAAAAAGAAGCAGAAGAAGTTTTTATGTGCTCGAGAATTTCACCAGTATTTTCTTCACACATCCAAGGAATCAAATCAATCAAACACC
CGTCAAAATCTACTGTAGTAGGCTTATCATATACTTTAACATTAGGATATTTAGCCAAAAGCTCAGTAGAGGCATTTGGATGCATTACATTTTTGTA
```

Figure 13(L)

```
GTGGAGATCGTGATTTCCTACAATAGTATGTAGGGTAATACCAGCATCATCAAGCATTTGAACTATTTCACGAGCAAACTCCATAGTTTTATGCGTG
ATCGCTTTTCGCACATCAAAAATATCACCGTATTGAATCCATACCGTAATTCCATTTTTCTTAGAATATTCTATCGCTTGCTTAATTCCATCAATTT
GAATACCGCGAATCCACTCATCATCAGCTTTAACGCCTAAATGCCAATCACCTAAATTTAAAATTTTCATAATATCAAGAACCGTCATTGAAATGCAA
AATAAAATTATTGAAATAAACCCATCTGGTGTGCTAAAGAAACCAATCCAGCATGCTCTAGTGAATAGATAAAATGCAAGAAAAAGTATCACATATC
CAAGAAATATCATTATATCAAACTCCGTATAAAGCTAAAGGGCCGAAGCCCTTTATTTTGTAATAATGTCAAACTGTTCTTTAAAGCAGAAGCTTGA
ATCTTGATGCTGATACAAAAATTCATAAGCTTTTTCGCGTTCGCGGTCATAAAGAGCTCGGTCAGATGACAGTTCTTTAATACGTTCAAACGTTGAT
TCCATATCATTTTCATCAAACCAAATGATACCGCTATCATGCGAGGTCAAAGGAGTATTATCAACACGGAATTTTAAATTTTCGCCAGTAGATTTCC
AAAATACCGGAATTGTTCCACATGCACCAAGCTCGAGATGAGTATATTCTAAAGAACGTTGTAGATATTTTTTGTCCAACTTACTCAGCTGATAACC
AAATCCGGATTTACTCATGCGTTCAAGCATTTCGCTATTTACATAACGGTCAAGAATTTGCGTTGGCAAATTAGGAGCAATTTTAATTTGGTCTACT
TGATGAAGACGATAATACTCGTATGGAATTCCTTTTTCTTTAATAGGAATGAACGCTGGAGAACGTTCCAGACCTTCCATAATAGTACTTAGTCCTG
CAGGTTTAAGATGTTTTTCATGAAAATCAAACATCTGATAAAAACCTTTCCATGTAGTCGTACGACCAATCCAACGGTTGATATTCATGTTAATTTC
AGAAACATCTTTCCAGTAGGTTGACCGAACCTTCGCAATATCCATAGGAGGCTGAAAGTTATATACTGTCGGTGCTTCTTCAATATCATCAAACAGA
GAAACTGTTTCAGGATACCATTCTTTCATCAGAACTTTTATTAAAATCACCATTATCAGAATGGCTAAAAATAACATCAGCTCGACGAACAGTTTCTT
CTAATCCCAAATTTCGGCGCAAAGAAAGAGAAGAATGGTCATGTTGATAAACTACAACACGAACAGAAGGTTTAATGTTATCAATAATTTTTTTATA
GTTATTAATAGTGTCTTCTTCAACCGAAGTAGCAGGAACTGAATTGATAATTAGAATATCACAATCATTTACCAGCTTAAGTGTTTTATCATATTCT
TTTGCCAATAAAACCGGAATTGAAAATGATTTATAATCATGCCGCGCAATTACGAGTAAATGATTTATCTTTAGCATAAACCAAAGTTACTTCATGAC
CATTCTTAATAAACCAATCACGTTGCTCAAGAGAAAATTTAGTTACACCACAACCTTCAAGACCTCGAGCCATAAAAATACATACTTTCATTTAATA
TCCTCTTTGTTTTGGTTTATTTTACCAAAAATTTATAAAGCAATATAGGAGCCGAAGCTCCTATCCACATAATACGCCATACAGAGGCTCGTTAGAA
CTTTTAAATTTTATGCGCTTATATTTTATAGTTCCTTCTGCGTTTGTTTTTAGACAATAACTTATTTGCTTTTCTTTCTGCTTCAAGACGGTTCTTTTCTTCAATAGA
GAATTTTATTATAATCTATTTCAGAAGTCTGGGTGTTCATCTTTCACAGTTGCCACCATTTTTTGACTTGATAGGAATCAACCCACACTTTCATATT
AGGGTCTGCTCTTACAATAGGAGGATTAACTTCTTTAATTGAACTATCATGGTATTCTTTTTCAGAAATTTTCACGCAAAGATGACCATTCAAAGAT
TCAGTAAATCCTGCATTAATTTTAAGACGCTTGAATTTTACGTGTGTAAGCATCAATCATATCCTCAATCTGCGATCTAGTAGTCTTCCAAAGAATA
CTGATGAGTTCATCGTTATATGGCTGTTTTAGAATATCCCGACTTTTCTTGATAGCATATTCGTATTGAGCAAAATTATTGTTTTCAGCTGCAGTCT
GAGCGTGCTTATAAAGACGATTCAGTTCGCGTTTGTTTTTAGACAATAACTTATTTGCTTTTCTTTCTGCTTCAAGACGGTTCTTTTCTTCAATAGA
AGAAATAAGCTTTTCCACTTCATCATTAATTTCGGGTTTATCAGTCATATTATTTCTCTAATATAAAATAAAAATCATCATCTGTTAAATGATACCG
ATAGTTTAATTCTACACCATTAGATTTAAAAGCGGTATCATACGGATTTTCTGGATCAATATCAATGTCAAGAGCTAAAACTTCCCTGAGATACATT
TTAAGTAAATAGGGAATAGCTTCAACTTCAGGTATTTCTTCCAAGAATCCGGAGAGGTTAATCGTTAGCCTCATATAAAAAATCCAAACTAGGAGAA
TCGTCTACAACACTTTTCTTTTCAGCCCCCGGTGTTCTATAGGTTGATTCTTCGTAATGCGTCATTTTATCGTAGATGTCTTGAATAAAAGTTTCAT
CTACTAACGCAACCATATCGTCGTCCACGGCTGTCATAGACATTGTGAACGAAATAACTATATTTCTTTGCAACTTCCTTACGTTCTTTTTTAATACG
TTGGACGAATGCATTAAAACAAGCTTGAGTTATATATGCATGTGGGTTTTTATATTTCGTTTCATCAAAATTATGAAGCCCCTTAATAGAAGCTTCT
ATACCATCTGCAATCATTTCTTGTTTCCAAGACTGGGTGTATCCTGAAAAGTTGAAACGTTTAGATAAGCCTTCTGCAATAAGCATAATGGCTAATC
CGATAGTATCATTCTGACGAACTACTTTATTTGGGTCTTTATTATTTGCTAATTCTGTTTTCCAATCAATAATAGCTTGTAAAAGCTCTTTATTGTT
TACGTAATTATATTTAGGCTTAGTTTCTGACATTTTCACCTCTTAGCTCAATTCATAGATCTATTATATCATAATATTTGAAGATCTATCTTAAAGC
ATAGAGGATATCAGTTATCTAAGTAAACAATATGCTTGGAATACTTTCTCCATCATCTTTTTAAATTCATGAATATCTATATAATGACTAGTTAAAT
CAGCATGATATAAAAAGTCTAAAAACTTTTCATGTGTGCTAACGTATTCACTTTCATTTAATTCAGAAACATGACTTTCCCAATATCCAACACCAGT
CTTATTTGGGAAAAATGAAATTTTCATGTATTGGTCAACATAGAAAATGCCATAATTTTCAATAGTAATAGAAATATTAATAAATTTCATCATTCA
TCAACTTAGCCGCTTCAAGAGCTGCATCTAGTGAATCAAATTGATCAACATATTCAATCAATTCGCCGTAATTGGCATATAACCACCATTGGCTAAA
TTCATACTCAAGGATGAATCCGTTTCCTTCAATTTGAGTTAAACCAATGCCATTTGTATTTACTTCATACCCAGCAAGACGTAAATCGTTAATAAGA
GCTTCGTTCATAATTTATACCTTAGTAATTTTCAGGTCTGCAAATTTTTTCTTGCGTTGATTTTTCATACGACGAATAGTTTTATCGGAAATTTCATG
CTTTTGATAAGCTTTAGATTCTACACCAAAAGCTTTAACATCAAATTCTGACAAGATATATTGAACCAACAATTCACGGACAGTATTGCGTCCAATC
TTCTGATCATTCTGTTTCATCGTCTGATGAAGCTCTTTTTCCCATTTATCCAAAATTTGAGGAGTTACAATATCGCCTTTTCTAGCAGAGAAACTA
CTTTATCATATGCGTAAGAATTGATGGCGTTTTTAATTTGAATAGTCATACATTATCCTCAATTGCATTAAAATTTTATTATCCAAAAAGGGCCGAA
GCCCTTAGCTAAACTTTTTGGCGCCCTTCCAGCCTTCGTACATCATTGCGACTGACAATGACAAGGCTCCTTCGCATGCTGCATACTTATTATTCCA
GAACCAATTTAGAAAAACTTCGTCCTCAATACCATTGTGTTTCATGTTCTGGAAAAATTTGGCGCGTTCTTCACGAAGCTTTTGCGATAACATAGAT
TCAGGATTCATTTAAATTTTCCAATTACCGTTTTCATCAATGAATTTAATCCAGTCATTTACTGACCACTTAGTTGTATCGCCTTTTGGAGTAGCAT
TTAAAGTATATAGCCCTTGCTTAAAAAGCATTCGTTTGATATTCATATTTTCCTCAGCTGTAACGATAACACTCGTTTGATTTGCGTTTAGCAACTC
GTTGAGAAGTATTATAATCAAAATCATCGTCAATGTAAACTGATTTTTTCAACTTTCTTACTTCACCACGTAATTGACGATTCAATTCATTCTTAAC
CTCTGAATCAACACCTCGCATACGTCGCCATTTATCTGAGCGAAAAATGTTTTCAACCATATCTTTATGACTTACACCATCAGGAGCTTTACGCTTT
CCGAAATAGTCATAATCACGCACTTTTAAGTCTTTACGACGATACGTTTTACCCATGGAGTTTAATTTCCTTAGCAACTGAACTAAATGCAGCACGA
TCGCAAATCATGCGTTTATGTAACTTGATATAATATAGCAAACTTCAAAACTATTTACATGATAACACGAACAGCATTACCATTAATGAGATAAT
ACTGTCCCTTTTTAATTTCTTTATCAACCATAACCATATCAATTCCTCAAAGGTAATTCATATGTTAATAATACCACAGTTTGAGCTCGTTGTAAAC
AACTTTGTGAAAATTATTTTAGGGAATGATAAGAAGGGAACGATAGCTTAGAATGGTAATATACAGAATGTAAGAAAGAAAGGCCCAGAGGGCCCGC
CTTAGTCTTCTATGATATCTCTATCATATCCAAGTGAAATGAGAGTTTCTTTGAAGTGTTTAATGTTCTTTTGTCTAGAATCATTGATGAAAATGAC
TGGATAACGAATGTTAAGAGATGTGAATCCAGCGCGTTTAGCAAGAGATACAATCAGTGGACGATCATACTCAATCTTACCATTATTTGTAAGAACT
TTATAGAAAGTAAAAGGAGCATTAAGCTCCTTTAGAAGTTTTGTAACTGATTGAACATCCAGGACAACGACCTACTTCATCTGGAATTCCATAGACTT
CAATCTTATTCTTTAAGTTCGAGTTTTGTTCCACGAGAAATAATTCCTTGATAAGCCCAGTATGGCGGGTTAACAGAATCATCGCCAGAATTTCTT
CAGGAAAATAAACCTGGATAACAAATCCAGATGCATCAAAGGTAAAATAAACCGTAGGTAATTCACCTAACAATTCAGCGCGGTTATTAATTTCTTC
AAGTTCTCGTTCTCGTCCAGCCCAAAAACTAGGATTTAGACTACATTCATAGAAATAATAGTCATTACCGAACATATCAAAACCCTTCCAACTCTCT
ACCACATATCGCTCAAAACTAATCATAATTAGGCCTTTTTATCAAGAACAGCATTCAGTTTGTTAGTAATTTTATCCAGACGCTCATTGAACTCGCT
AGAAGATAAGCCTTTTCTGGAGAAATTAAGCTAATCACGAAAAATATAGCAATAAAAGGAATAAGAAAAATAGCACCAACTGCCATAAACAAAAG
AACGTTACAGTTGTAAGAAAATCGACTAAACCTTTACGAAATTTTACATATTTTACCCTTAATTCTAAGACCCAGGCATTGATAAGCACTAAACTAT
ATTGCGAATAAAATTCTGGACCAAAATGAAAAATCATATCATTTATAGTATCCATAATGTAATTCAATTTACGCCAGAATGCGTTCGCACAGCCGCC
AGCCGGTCACTCCGTTGATGGTTACTCGGAACAGCAGGGAGCCGTCGGGGTTGATCAGGCGCTCGTCGATAATTTTGTTGCCGTTCCACAGGGTCCC
TGTTACAGTGATCTTTTTGCCGTCGAACACGGCGATGCCTTCATACGGCCGTCCGAAATAGTCGATCATGTTCGGCGTAACCCCGTCGATTACCAGT
GTGCCATAGTGCAGGATCACCTTAAAGTGATGATCATCCACAGGGTACACCACCTTAAAAATTTTTTCGATCTGGCCCATTTGGTCGCCGCTCAGAC
CTTCATACGGGATGATGACATGGATGTCGATCTTCAGCCCATTTTCACCGCTCAGGACAATCCTTTGGATCGGAGTTACGGACACCCCGAGATTCTG
```

Figure 13(M)

```
AAACAAACTGGACACACCTCCCTGTTCAAGGACTTGGTCCAGGTTGTAGCCGGCTGTCTGTCGCCAGTCCCCAACGAAATCTTCGAGTGTGAAGACC
ATTGTATATCTCCTCTTTAATCATGTTTCCACACTCCGTCGGTATTTGACCAAAGTCGCTGATTATCTGATCCTCGCCACAGCTTTTTGGTCGGAAG
ATTTTTCTCATACTTCCCATCAATAATAACATCAACATATTTAAGCATTTCTAGTTGTTTAATATCTTCAAACTTATATCCTGTCCACAACCAAATG
CTTTTATTGGGATAAAGATTTTTAATAGTTTGAACCACAGAGTGAATCACGTCTCTGTTATCAGGATAGAGAGGGTCACCTCCGGTTATAGTCAATC
CTTCTATATAATCATTATTCAAACATTCAATTAATTGTTCTAGTGTTTCACCAGTGAATGGAACACCATTTCTAGCATTCCATGTTGATTTATTATA
ACACCCTTCACATTTATGCAAACAACCTGTAACGAAAAGAACGGTCCTGCAGCCAGGACCATTAACAAAATCGCAAGGATAAAATCTATCATAATTC
ATTGGTGCTTAACCCTATGCATGATTTCTTTATTTTGCCGAGATTAAATCCGCGTTCGTTCGGATTTCCCAAATAGCCACATGTTCTTCTTATTGT
GTTCATCTTTTTAGGATCAGTTTCTCCACAAATAGAACAAACAAATCCGTTTTCAGTAGGAGTCATTTCATGGGTACTTCCACATGTAAAACATTTA
TCTACTGGCATATTAACACCAAAATAATCTAAATGTTGTGCAGCATAATCCCAGACAGCCTCAAGACCTTTTAGGTTATTTTTCATATCAGGAAGTT
CAACATAAGAAATGTGACCACCTGTCGCAATGAAATGATATGGGGCTTCGCAGGAAATCTTTTCAAACGGAGTAATATTTTCTTCTACTGAAACATG
GAAACTGTTAGTGTACCATCCTTTATCGGTAACATCTTTTACACTTCCATATTTTTCTGTATCAAGTTTACAGAAGCGATAACAAAGGTTTTCAGCA
GGAGTCGAATACAAACTAAAAGCAAATCCGGTTCTTTCAGTCCACTGCTTAAGATGAGCATTCATTTTAGTTAAAATTTCTTGTCCAATATCACGAC
CGACAAGAATATTCAATTCATGAATACCAATGTATCCTAAAGACACTGAACTTCTACCGTTTTTAAATAACTCAATTATGTCGTCATCAGGTTTAAG
ACGAACCCCGAATGCACCTTCTTGGTAAAGAATAGGAGCAACAGTCGCTTTAACTCCTTTTAAGGAACTAATTCTACACATCAAAGCTTCAAAACAT
AAATCCATTCGCTCATTGAACAATTCAGTAAATTTCTGTTCATTGAACTGTGTTCCAATATAAGAATCCAACGCAATACGAGGAAGATTCAGTGTTA
CAACACCAAGATTATTACGTCCATCAAGAATTTCATTACCGGTTGAATCTTTCCACGCACTCAAGAAACTGCGGCAACCCATTGGAGAAACAGGAAT
AGATGAGCCGGTGATAGCTTTATTGTTCTTAGCTGAAATAATATCAGGATACATCCTTTTGCTTGCACACTCTAGAGCAAGCTGCTTAATATCATAG
TTCGGATCGTCTTTATAAAGATTAACACCTTCTTCAACGAACATAACAAGCTTAGGGAAAATAGGAGTTATCCCATCACGACCGAGACCTTTAATAC
GATTTTTCAGAATTGCTTTCTGAATCATTCGTTCAGTCCAGTCAGTTCCCGTACCAAATGTAATTGTTACAAAAGGAGTCTGTCCGTTTGAACTAAA
GAGAGTATTTACTTCATATTCATAAGCTTGGAATGCATCGTATACATCTTTTTCTGTTTTAGATTGAGCATAATTTAACGCATCAGCGATTTGCCAT
TTTTCTGCATCCTCAATATGTTTTGCATAGGTGCGTTTAACATAAGGAGAAAGTACTTTATCTACATTCGCAAAAGTCGTTCCGCCGTATTGGTGAG
AAGCAACTTGCGCAGTAATTTGTGCCATAATTGCAGTAGCAACTCCAATTGATTTAGGAGTTTCAATCTGTGCATTACCAAGCTTAAATCCGTTTTC
AAGCATTCCTTTTAAATCTACTAAACAACAATTAGTAAATGGAAGAGCAGGGGAATAATCAATATCATGGAAATGAATAATTCCGCTTTCATGCGCT
TTCATAATAAAAGACGGGACCATATTTTTGGCAATGTGTTTAGACACAATACCAGCCATAAGGTCCCGTTGAGTTGGAAAAACACGAGAATCTTTAT
TAGCATTCTCGTTTAAAAGGTCTTTATTAGTTTTATGAATCAATCCTTCAATTTCTTTTTCAATTGTCATTTTAAACTCTTTCTAAGCTGCTTCTTA
AATGAAGCTATTAATTGTGTTTTAGTGTCAGATTCATTATATTCAAATCCTCTTTGAAGCATCTCAGCCATCATTTCCTCTTTTCCTAAACGAGAAA
ATTCCTTTGATTTATCTCCAACAAAGTTAGGGTGAATATTATTTTGGGTGTAATCGGATTTTAAATAAGTAAGTAAATTTTCTAACCATTCAAGATA
ATCAACACCTTGCCCCTTTAAGCCAGAACGATTAAATTTATGTTTCATTTGACCTTCTGCGGCATTGCAGAGATTACAAAGCAATCCACGTACCTTT
CCTGCTTTTGGTCCATTTAATTCATGGTCATGATCAAGATGATTAGCTTGAACATCAGGATTTAGTTCTCGTTGGCAAATTAAGCATTTACCGTTTT
GTGCATCATAAAATTTCTGTTTTTCTTCTTTGTATAATTTGCCAGTCAATAACATAATAAACCCTTACCTTAAATAGATAAGGGTATTTATTATTTT
CAAGTATTGTAAAACATTCGATGCAATCGTTTATACTGTCGAATCATCTTTTTAGTAGGACGAGAATAGGTTCCTACGCAAGTGGTCATATGAGGGT
CCGTAGAATGTCCTTTAATAAAAAGTTTCCAAACCTTACCGCCATTTAACTTTTCAGTATAAACCAATTCGGTTTTTCATTAAAATGTCCTGTCAGAA
AAAGAATTTTGAGTTTTTTCAAGTATTGTAAAACATTTGATGCAATCGCTTATATTGCCGAATCTTTTGGTCAGAAAAAGAAATTTGAGTTTCAAGC
CATTCAATGTACTCTGCGGCAGCTTGCATCAGGTTACCTTCATAGCCATCGTTATTTTCTTGCGCAGCTAATTTAGCTAATGCGTATGAAATACGTT
CACCCTTGAAAAGCGGCTTTAGGCTTCTGAACATCTTGGCTAGTTCTCTCTACAACTTCTTCAATTTCGCCATTTTCAACGGATTCAGTATTCCACAA
ACACCAGTATGTAATTGGCTTATCATAGATGTTAATAATCTTTCCGTCGGAAAGTTCAATTATTCCAGTATCAGGTTCTATATCATCTTCG
CATTCTTTTGCAAGTTCACGAACTTTAAAGACAGTACCTGCACTAAGTTCCGGCCAGTAATTACATAGCCCTGTATCAACACGATTAATTCTAAACC
ACTTATCTACTGTAATCATGCCCCATCTCCATATCAATTAAGTCATTTATCGTTGGTTCATTATATACTGTTTCTTCATCAGTGTAAACCGGTTCTT
CCGGCTCTGGCTCTACAGTTTCCCATCTAGCCGCCCACCAAGGTTTAACCCCGAAGCTTATTAAGTTCTTCATAATCAATCCAGGATTCTAATCCTG
ATGGCAAATCAGATTCAATTTCCCAAAGAAGCTCTTCAATTTTCTGAAGACGATCTAGTTCTTCGGCTGGAATAGTAACCATTGACGGAGCTCGTGA
TACATTAATATCGTAAATCATATTTACCCCAATTTAACCATACAATCGCCGTATTTCCACCATTAGAAATAGACTTTTCACCATTAGAATAATAAACTT
CGAGTTTAGCACGATTATTTTTAATTTGAATAACCTTTGCTGTCATCAAAGTTCCATACCCATAATAAACTGCAACTTCATCACCTACATATACCGC
GCTTCCGCGGTAATCATGAATATAGTCATTTCCTTCGAGCATCATTTAAAATATTCTCGCAGTTGGTCAAATCCACCAATATGACTTCCATCAGGAG
CAAATACCTGGGGCATTGTTAAGCCGATTTGAGTATCACGACCTAGTTTAGTCAGAAGCTCAGCGATTTTCTCATCATCAAAAACACCCTTTTTCCGG
CATAATGTTGATAAATTCAAACGGCTGTTTCTTCACAGTCAAAAGACGTTTTGCATTATCACAATACACACATTTGTGGATGTTGCTATCATAACCA
TATACTTTAAACATATTATTCCTTAATTCCTAGTACTTGTTTAAAAGTCTCGTCGTAATCAAGACTTTGGCCCGTTTGTTCTTTTATGTTTGTATATA
ATATCACTTACTTCTGATAGCATATTTTTATATGAACGAGTTAAAGCAGATTTAAGCACGCTGTATCTATCAGGAAATTTACCGTGTTCATTATAAT
AAGCTATTGCTAATTCACGGACTGCCTTTTCAGCAGCCTCCATATATTCTTTACGCTTGGTCATTTTTAATCCAAAATATTATTAGGCATTGGTTGA
ACACTCACAAGTTCTTTAAAGAACTCAGTAGAGTCAGGCAATTTAACCATTTCGGAGCATGCTTACTGAATTTATGTTTACATTGACGGCATTTAT
ATTCAAGCTCTGGTTTACGCCAGTTAATCAACTGAACTTGTTCAGTACCGCATTCAGGGCAATTAGGAACGTTTTAGAAGCTCTTTCACGTCGTTC
AACCATAGCCATAATAGCATCCCATGCTGGAGGTTTAAAATCTAAATCGTCGCAGCCGTGAATCTTTCCACGCATTTCCATATCATCTTCCTCACCA
GCCATAATAATTTTAATTAAACTGGAATTACTTGAAGCTGCAATGTCTTCTAATAAACGCTTTTTCATTTCAATACCTCAATAGCATTACGTAAACC
ATTTGCTTTTGCATTAAGAGCTTTTAACAATTTGGTGTGTTCTGCAATTTGGGCTTCAACTTCAGTCAAACGGGCATTGAGATATTCACGTTCTTCA
CTCAGATTATCAACCTTTTCTACTTTAGGCTCTTTTACAACTGTCTTATATGTATTAGGGTTCTTCAGTTTAATTAGAATGCGTGAACTGTATAACA
TTGAACCATTATCTTCGGTTTCGTCATACATTTCCACTACGTCCATAATTTTTAACATCATGCGGAGTTTATAAGCAACGAACGAATAGTTTTGTT
GTGCTTATTAATTTCTTTAGCTGTAATGGCGCCAAGATTACGTGAGTAATAATAAGGAACCTGGATATTAATTAATACTGATGAACCACCTGGCTTG
TGTGTTACTTCATCAGCAATAACCCAGTCCTTAACATGAACTGTATTTGTACGGTCATCGCCTGCAGTAAACAGCTTGCGAGCATGCTTAAAAAGCA
TATTCACTTGGTCATTGAATTGACAAGCAAATTTATCAGCAAATTTAGTTTCAGGAATGGTAGATAACCAATCAGCCAAATGGGTCTTTTTAACATC
GTTAACAATAGTAAATTCAACCAAATCAGTTATAGATGTCGCAGATTTAATGAAGCTCGGCTTCATAAAGTTTTTAATGTTATCACGAGCTACAGTA
GAAGATAACATACGAGAACGTTTAAACCATTCAAGCAAATTGCCTAACGAATGAGAATAAGCGTTTGAGTATCTTTACAGATATGATTTTCCTGAC
CAACATATTGAAGGAAATCACGAAGAATATTATTGATTACTGCTCTGTGCCCGATCTGATAATTACGGTGTTTAGTAATAAGGCTGTCAAAATAATC
AATATAATGTTTACGAGTTTTCATGTTCTTCCACTTGGTTAATGATTTATACTCCGAGCCATCCTTGGCTTTAAATTACTTAATTAACTGTAAAGC
TTGTTCAAGACGATCAAGACGATTAACGGATTCTTCCCAAATCTTTTTAGCCTGCTCATATTCTTTCTGCGCTTATTAGAAATTTCTAGAACTTCT
TTATAAGCTTTTTCTAGTGCAATAACTTCTGGACGAATTTCTACTGGTTCAGGCGAATCGTCAAGACATTCCATTAGTTCCTCAAGGGTAGTTTCTT
CTTTAGGAGTATTCACAATTTCATCACATTTTTGTTGGTAAATTTCTTTATCAGTCGGTGAGTACGCACACTTTACTTCACGGAGACTAACTACAAT
TTTATATCCTTCCCAACCGCATATATTCTTAAAAGGATAAGTATGAATATTTTCTACTGTTTCCATACAAAGTAATGCGGTCTCTAACTGACGAGTT
```

Figure 13(N)

```
ATATCGCTAGCAATTGAGAAAAATTTATTAATGTTCTTTTGATTAGCTTCTGGTGTAAAAAATTCATAATTCACAAAAATAGCTGCTTTATTTTTAT
CAAGCTCATATTCTTTTATGATAATCATATCAGAAGCCCAAGGATGGATTTGACGATAATCACCATAGCATAATTTAGAAGCTGATTTTAGAATTTG
CTTCTTGAAAAGTCTAAAATTACTAATCCAACGACGAGTAAAAATATTCTCAGGGTCTTCTTTATTATTAAGATGATAAGAATTAACATCACCGAAC
CAATTATATCCTACTACATCTTTAGTTCGTTTAATTTCTTTCCCAAAATTACCAAGAATATCCCGATTAACCAAATATGAAAGAAGACGAGACTCTT
TAAAGGTTTTCTTGATAACATCTTTATCTACACGGCTAGAAATTTTACGAATTTCATGAATAAATTTAGTAGAAGAAACAATACTTGCATCAACACT
ATTGAGCCATTGATTGATAATAGAAAGAACGATATTTTGACCAAACATCGGTATAGCTTTATCATCAATAACGCTATTGAATGATTTGATATATTCG
TTACGAGTCATAATAATCTCCTCAGTAGAAAGTAAGAACATTATACCACATCCTTGTGGCAAAGTAAACTAGTTCAGTGCATTTAGTGCATTGTTCA
GTTTAGAACGTTGCTTCGTGAGATTTTTGACTTTTTCTTGTGCTTTTTCTAGCATCTTTTCAGCTTCTAACACTTCATTGGTCGCTTTAACGAGTTC
ATCATCTACTGCCTTAAGGGACTTCTCAATCGCATCCGCGTGCCATTTTTCAACAGGTTTAAGACTCGGATTTTCAATAGGAAGAAAATTCACTTTA
TTGAATTTCCATGCATCTTTATTACCTGAACTATACATCCAAAATTTAGGATCATTTGACGAGTAATTAGATAAATTTAAGTTATCTTGCACTTCCT
GCTTTTTCTCTTGCGGGACTTCGTCCTTTCTCAAAAAATCGTATTTAAATGAAACGATCATATCAAGTTCATATGATGTTGTATCTAACTTAAATCG
TTCAAAACGAGGTAAAATCTTAGATTGAACAGCAGCAACAACATCCATATACTTAAATGCTTCTGTCAACTGTGATTTAAGACATTCACAAATTGAA
AGAGAATTTTTAGTATTAGGCTTAAAGCTGATTCGCGCAGTTCGATTATTTTCTTTAGATGGTCTTACTTCCATTTGAAGAGTATAACCATCAAATT
TCAGATTCTTTAAGTTAATATCAGAACCTTTTAATCGACTAGCCGTAGACAAAATTTGCTTTAATTGTTTACGGAATAAAGCAATAAATCTCCATTC
AAGACGATAATGATTTGGATTATAAAATCCCGTTGATAGATCAACTTTACTTTGACCAACGCCTTGAACAAGTAGAGGATTTTTATAATCAACGGTT
TTACAGAAATCCATGAGCTGTTCACGGGCAGTCATTTGCGTAATATATCCAGCTTTATCAAAATGCCGCAACCATTCAGCGCTATTCAATGAGTTAA
AGTGAATATTACGTGTAACTTTATCAGGGTCTAAATTATTTTCACATAAAAATGTTATGACATTACGAGTATAACTAGCATTACGAACCATATCTTC
AATTTGAGAACGAGTTTTCATAGTATTCCTTAAAATTTAAGTAAATCGATAATTTTAATTAAATTTTCACGCTCAGATTTAGCTTTACTGCTTAATC
CAGACAATCTAAAAATTTCATCGTCATATTGTTGAATAGAAATATTTAGCTCTTCAATTTGCTTATTAAAATAATCAATTTGTTCAGAATGTTTTTC
GTTACTACGAACTGGTACAGGTTTTGTAGGAAATTTAGTTAAACTGGATTCATCCGGGCGATAAATTAAAATGCAATTTGAACCAATCGGGCATTTA
GCACCAGATGAATATTCTAACGTTCCAGCTTCTTTTAAAACTTCAAAAGCTAAACAGAGATGATGCCCCATATTAACATAATCTGTAGAGCGAGCTC
TGATATAATAATCATCGCCGCGAATACTAAATTTAAAGCATTTAAGGTCTTCTGTATTATTGGTCTTAAAAATCATTTGTTTATCTAGACCTTTAGC
TAATCGAGCGCCTAATGCTAATAATCGTCGTTGATTTTCCCACAAATCTGCGATCATTTGGTCAAATGATAATTTCGGCATTAATCGACCATAAAGG
TCATATCCTTTATTATAATTGCGAAGGATTTCACTCGCATTAATACGGAGACAACGCTCCAATTTTATTAAGGGCTTTCATGATGCGATTAGATAAAC
CCATTCCAGACCCGTTTGTTCGTTGTTGTAAATGTTTATCTAATCCAAACCCAATATCAACTTTAAATTTATCTAAAATTTCAGCATGAACATCTCTGTC
AATAACATTCAAATCCAAAGTTGGGTTAAATCTATGAAAAAATTTATCTGGCTCTCCACGACGAAGTACAGTCCATTCATTCAATTTTTTATTAACT
AAAGATTTAATTACTGCATTGACATTATTAATTACTACTGACATATTTCCTCACTCAATTTCAATTTTACTAAATACGCAGAATATGATGGAAAAGA
CTATATAAGCACCGCATACAGATTGAACTAATACCATTCCAAAGAACCAAACAATATTATCAAACAATGTCTGTTTTACGTCGAAAGGACGTAAACT
TACAGTAATATTATCACCTTTTTCTATTGAAGAATACATCTCTGGGGAAATATATTCACTAAATCTATAACCATCTTTGAGTTCATATACGGCAATA
AACGATAAACTAGACCCTTTTCCTTGTCTTCGTCGTAATGGTATTAACTACAGTAACATCATAATCTTTGATAATGCATATAATCATTAATTGCGTAAT
AACCATATGCAATTACTACACATAAACAACATATCAATAAATTCAATCTTTTAATTATCAACTGTTTCATAATAATCTCAATTAAAAGGGCTTAGAA
CCATTATACCATCCTTGGTATAAAGCGGTTATGCGAGTACCGTCTTTAACCGTTCTTCAAACTTCCGAAGAGTATTCTGGCGTTCAGCTCTTTGCTT
TTTATAAGTTTCAATACGCTCTGAAATGAGAGTGTATCGTTCATTTACTGATTCTTTCATAAAATCAGGAATTTCACGAGAAGCTTTAATCTCGTCA
AATTTATCAATAACAGCTTGCTCTTCAGCAATTAAGTTATCATACATTAAAATATCTTTCTTGATAAACTCAATATCTTCTTGAGTTACACGAGATA
ATTTAGATGCTTTATCCTTTTTGTACTGTTCGTTAGTATCACGAGACCAGTGTAATGTACGATTTTTATTCGTATTTTTGTAAATTTCTACAATACC
GATCTCATCGATAATAACGATCCAATTCCAACGGGATTTGTAAATTTGTCCTCCATCAACAGTGATTTCACCTCCGATTGAGATGTCATTAAAGAAC
TTGCTTTGCGCTTCAGATTTAAATTTACCATCGTTGTAATTTACTAAGTTGAAAATATCTTTAGCGTTCATTTTCTGTTCCTCCGTAGTTGATAGTT
GTATAGTACCACAGAGGAACAGTCTTGTAAACCACTAAAAGAAACTTCTTTCACAATTTTTTCCACTGAACCATGCGCTTACCGCTTTCTTAGTCTC
AGGAGCAGTGTTATCCATAAACCATTCAAAAGGCAGCCTTTTTATGATTCTGGAGGGCTTCTCGGGCTTTAATCTGCTCACGGTCTATTAACACTAAC
ATATGAGCCTTTCTTGTCACCATGGGCTTCTTATGATTTTTTGAATATTCCCAATCATTTGTCCATCGCATCGTTGTTGCGAATTGAAGTACAGCTT
CTTTAATTTTAGTTTCGTAAATTTCACGAGCCTTTGAGTATAACATCATTACCTCCATTTACCAGTTTAATTCTAGTCATCTTTTTGATGGCAGTCC
ATATAATCTATTTCTGAACTGCCTTTTTGTCATAGAAGTCCTCTTATGAATTATTTCAGAAGAGTAACCTCAGCGATTTCTTCCCAACCGTTTTTGT
CGGTCATAATAAAGTCAGCAAGATAAAGAGCAGTACGCAGTGAAACATTGCGTAAACGATTAACATTGACTTTCATCCATGATAATGCTTTATAAGT
TTCTTCATCAGAAAGACCGCGTTTTTGCATCATGTCAGTTGAAAGAATAACATCTTCAACCCTGACCATAATTTCTTCATTAGTGTGAACACCCAAA
TCTAAATAAACTGAGCGGGACACTAATGCTTGTAAATGTGGAGCAAGTTTAGTACCACGGTCTAATTCGCGGTCAATATCAACGTTTGTGATAAAAA
CAATCGTTCCTTTAAATTCAAACTCACGCTCAATGCCTTTTTCTTCAAGTAAGAAGATGCGGTGCTCCAGCAGACTTTACGGGTCTCTCCAGTGTC
CAGAGCAGCTTTCAGAAGATTAAGAATGTCCATATCAGAGAAAACATCCACATCATCAATCAAAAGGACAGAATTCTCTTCACGATTATTCCAAAGT
TGTTCATAAAGACCGATACCGGAGATTTTACCGTTAATGCTTTTATATTCAATGTATCCATTATCATTTGCTTTATTCAAAGCTTTATCTAAAGAAT
ACGTTTTACCAATACCCGCCGCACCGAGATAATTAATGAACGAATGTTTCCGTTAATAATACCATTCGTCATCATTCCCATAACATTAAATCTTTT
ATTAATGCGGGTTTTCATATCTTCATATGATTCTTTAACTTCTTCAACTTTTACACCATCATATGAAATGTCTGATTTGTAAACCCAAACACCGCGA
CGCTTACCGTCAATTTCAACAAAAACTTTACCATCTCCTTGTGCATCTACCGGAGCATTACTGGGAACCATTCACCTAAGAGCTCAAAAGTTCCAG
AGATTTCTTTACCGAAGTAGAATACCCTTATTGATAGTTACAGTTTTCATTTTATTCTCCAATCTCACATTTGTTTTGATAGGGTAATAGTATCACAC
TACTACCCTTCGTAAACAATTTATTTTAACGTTCGCCAAATTTTTACTGCTTCACGGCGAGATACTTCTACAGCTCCAAGTTCTACAGCTTTTTGG
CGTCGGCGAGCGTGTAAGTCATAATGTTTAATGCGTTTATCTTGAAACCAAGAACGTTTCATTCCTATTGCTTCTGCCATTTCATGAAGCTCTTCAA
TATCTCCATCAGTGAACATATGACAATTTTAGTTGGATGACCGGGAAGTTTCCATCCATGATTCATTAAAACATCTACGTAAACTGTCATTGATTC
TTCTCCAAATAAGTTTCGATAATTTTCTGAGCGAGATAAACTGCATTATCTTCAGTTGCATCTTCAAGAAACTTTCAAAACACTCTGAAATTTCTT
CTGTGTCAATCAACTTTTTTACTTCAATTGGTGTAATTTTCATTTTGTTTTTCCGTTTAAGTGTTTGTTTTGATAGTTGTATAGTACCATAAAGCTT
TATGCTTGTAAACAATTTTGTGAAAAATTTTTGAAATAAAAAGGGAGCCCGAAGGCTCCCTATCATTTATAATAACTTCGGTGGTTTCAAGATAG
ACCTTCTCAAGGAAGTCATCCCAGAAACTCATGTCTACTTTTTGCTGCATACCGTTCTTAGAAGCTTCAGTAGATGATGCTTCTACTTGATCGACCA
CATCTTCCAAAAACTCTTGAACTGTTTTAAATGGATGCTTACCCAACTTCACGTCGAGAATAAAATGGAGCATCTTGGAGTGGATAAATCAAGTCGC
AGTTTTGTAAATTTCCAATAGTTGGAGTCCACCACGACAAGCATGACTCAAAGCTTTCCAGTCAATACCTTCATTGGCTTCGGCCTTACGAGCACGT
TCACCATATTCAGCATCTAATTTGTTCAGTGACTGCTTAAGCTCAATAAGAGAAAGCGTTGTCTGATATTTACGACCCAACACAGTGTAGAACGTTT
GTGGGCCTGTTTTCTCATGATTATGGAACACCCATTCACAGAATTCGTTTCTGGAAGACGATGCTTAATATCTTCAACTTTAGTGCGACGCTGCTT
AATAGAACCATCTTCTTGGTAATCAATCCACTGCTCAGGGATTTGATTAACTACTTTCAATACATCACGTAATGCAGCCAAACGAGAACCTTTGACA
CCGTATTTAGAAGCTTGCTTGCGGACATATCCTAAATATGATTTCATGTTAGTCGTATAAAAACGAGAACGGTTGTCTTGAATAAACTTCCACACAT
CAGGCAAATCAGATTTAACCACTAGTTCAGGTGGAGTGTGAAGCATATCCAATGCTACAGTTTCACCATCTGCTGCTAATTTAAAGAAATATTTAAG
```

Figure 13(O)

```
ACTGTATAGTTCATGGTCAATATCATCTTTAGTGTTTTTAGATGATGTGTTGTTAGTGTTTTTACTCATGTGCTCTTTAACATTTCCAATAAGAATA
TCACGAGCAGGAGGAACAAAGATTTCTTTAAAATCTACATCAGATTCTGGGGTAGAAGTTCCATAAAGATGACTACCAAAATAGCTTTTCATTACTG
TTTTCATCATTCAGCCTTATATTCAATAACAGGACATACTTTAGCTTTACGCGCTTTTAAAAAATTCGATGATAATAGATTTCTTGGGTTGAATAGGA
GGTAAACCTTTATACGCCCTATCAATATTTTCTACATGTAAAGCATAATCCTTTTTCCATTTATAATCTTTATATTTTTCATGCAGTTGTGCAGGAA
TAACAAATGAACCAATAATAAGTAAAATAAGCAAAATGGCAAGTATAAATGCTGATGGAATAAGAGTCCATAAACTACCAAAAATAAGCCATTTCTG
TATGATTTCTGCACAGATAATAGTTAGACCTGCGAGTATAGTACATCCGAAAAAAGAAACGAAAAATGTAGGGATAACAATAGACCAAAAGTATGCA
CACAGTGTCTTAGGTCGTTTCCATTCGTCGTTAAACAGTTTGAATAATTTATAGTGCCAAGAGTTTTCATTAATAATCATAATTATCCTTTCATTGA
AGGTGTAACAGTTGTTAAATACTTAATCATAGCTTCAGCTTCTGATTTTGATAATGAAATTTCTTCATTGTTTTGACGAATAGAAATAAAATCCGGA
TGACGGTCACCACCAGCTTTTAAAACACACATATAAGTATCAGTTTCATCTTCAATATCTGAAATGATTGAAGCAGTTCCACATGAATGTGGTTTTT
GATAAATCAATACAGCTTTTCTTCCACCGTTTGACTGTCATAAACTTTTAACACATCAAACAAATCGCTTCTTTTATCAATAGCTAAGATGTTGTT
TTCATCTTCAATATTAAATCCTTCGGATACTTCATAAAGTGTCACCCATAAATCACCAATATCAATAACAGCGTTCACTTTTCCATGACTTTCAAGA
GCATTACAAATTTTCTTAATTTCATCATAACTCATTTTAATAATATCATCTCCTTGAATAAGGAAGATGTCATTTTTAAATTCAACACGAATTAAAC
CACTTCCACTTGAAATAAACATATTTCCTCACTTTGAAATCATAGTTGGAATGACAGAATCGAGATAAGTCTTTAGCGCAATAGCTTCGTCTTTGGT
AAATGTGACAATATACGATCGAAAATCATCAATTTGACGAATAGTTAAGACATCACCATCTTCATAGCATTTTGATACGTTTAAAACAGTTTCATCA
TTCTGATTGCAAGCGTTAGTAATAATAGCATTGCAATTTTTGAGCCATTTTAAACTATGTTTTCTTTCATTAGAATAATAAAAATATTTAATCTTAT
CTATAAAACTATCCCAATGAATAACTGATAAACACATTGACTCACTTTTAATATTAAATCCTGGGCATGAAGAATAAAAATGAATTTTGTGCTCATC
ATTGATGCTTACTATTTTATCAGTATAAGGATATTCAATTTGGGTTAAATGAATGATTTCACTAGGCGTAAAATATAGCATATCGTCTTCTTGTGTC
AAACGATACATATTATTTACTTTTTCTATAGCTAATTCACCAAAAAGCGGACTAACTTCTAATACTAATCGTTTCATATTGATTCTCTTCGACTCAC
CCACAATTACATACTCCTTTGAATAATATCAATAATGTTGTTCACCAGATTATAAGTAAACATTGGATAATTATATTGAATCATCACATACACAACA
AACAAAACTTTCATTCTCTTCTCCTTGGCAGTTGACAAGATTACTATATCATAACCTTGCCAACTTGTAAACCATTAAATGACGTTTTCAATAAAAT
TCTGAAGCTTTGTGTGAGCATCAACCATGATTTTCATTTCTTCCTTTGCGAAAGCTGTACCTCTTTCCCTAGCAGAATACTCATAGTCAGAAACTGC
ATTAGCATATTCTTCAATTAGCTTCATTAAAAACATCTGCTTTTCAGTTTTCATTATTCCACCTAATCATTTCAAGATATTGAACTAACTTAGCTTT
GGATTTATCCAAATCCTTTTTAGCTGCTTCTATACCATCGTATGAGTATCCTTCACAATGCTCAACTGCTAATTGATATGAATCTATTTCAACATCA
CGTGCTAATTTAATAATTTTTCAAACTGTTCACGTGTTAGCATACTTAAACTCTCGTATTATGATCGATAATTTCATCAAGAAACATATCTAAAGCT
TCTACAGCATTATCAACTTTAGCTTCAAATTTTTCAATACCTTTATTTGCAATGCCTGCCGAAAACCAAGCAAAGTCACTAAGTTCCTCATCTGCTT
TGCGAATTAAAGCTACCAATTCTTTAATTTTATCTGCTTGTTCAATTCTAGTCATTATTCCACCACATATGAAAGAGAGAATATTGCACACGCCATA
TGAGTTGCAGCTTCATCACACATATCATAACGTTTCTTAAGAAGTTCTACAAGTTCTTCACTAGTAACTTCATCCATGTCGACGAAAAAATCACCAT
TAATGATGACGTAGATATTTCCTTCTTGATTGAGTGCTTCAATTTTCATGATGTTCTCCTCTTTATCCGATGGTTGTATAGTATCACAGCTCAAATT
GAAAGTAAACTGGTAAAATGAAAAAAGTCTCCCGAAGGAGACTAATGTTATTCGAGGGAAAGAAGATATTTGCTCTGGTAAAACATCCCAGTAATAT
CATCTATCGTGCTTTGAATGGCTGGAGGCATTTCTTTATAAATGCTGTTAGGTTGCTTAGTATGTGATCAATCATTCTAATTGTGTCGGTAGGAAG
TTTACTGGCATCTGGAATAGAAGGCGTGTATTTTCTACCAGAATACCCCAAATATTGCTCACCAAATTTATCAATCAAATCTGGCAACTCAGAGAAA
ATAAAATCGTATGCTTTGTGTCTAGCATAACTTTTAGTTTCAAAATGCGCAGAATGAAAATAAGCTTGTCAGCCATTAATAAACCTAAGTATTCAT
CTGCCTTTGAAGGTTTTCCACTTTGTGAAAAGTCGCTGAATTTCATTCAGTCTCCAATTTAATGTTCATAATTCTAGCGTATGATTGTGCCATCTCC
GCGCCTCGCTCTATACATTCAAAATCGGAAGAGCACGGGTCATTTTTATAAGTCGTTCGCATAAAACTATAGAACTGTTCAGATGATTCTACGCTTT
TATTTTCAAAAAGCATATAAACGTGTCTAATACCAAGATTCCATAAATTTATCAAAATGAGGATCGACATTCGCTTCAATTGGTGGAGATAAAGCAAA
CGCTAATCCTAGCATGGCAAATAGTGCCGTTGCTTTTAAGGCCATAAAGGCCTCCTATCATTTTTGTCCTGTATTTACTTTATGCCGATGCACGGCC
TTAACTTTATCAAGGTATTTTTCAAAATTTCGCAATCTAGTATAGTCTGCCGGAGATTGGTTGAGTGATACTTCTCGACGCAAAGCTGAAATGATAT
TTCCAACTTCCCTACGAATTTCATCTAATTGAAGAACAGTAAGATTGCGAAGTTGCTTTTCAGTTAATTGTAGCATATATACCCCTTTAGTTAGATA
AACCTATTTATAACTTTTGCACTAACCGAGCTTTTTAGTTAATTCATTCCAATGTTTTCTACACAAAGAAACATAAATTTCATCACCAATACAGATT
TGATTACCTTCTTTAACTGGTGTTTCCATCTTCCATTAATCGAGCTGTCATAATAGCTTTTTTACCACAATGACAAACTGCCTTTAGTTCAATAAGTT
TATCTGCAATCGCCAAAAGTTCTTTAGAACCTTCAAATAATTTTCAAATGAAATCAGTCCTTAGCCCATAAGCCATAACAGGAACATTATATGTATC
AACAATTCGACTTAATTGATGCACCTGTTCAGTTTTTAAAAACTGAGCTTCATCTACAAATACACAATGAATATCTTTTTGTGCTTCAGCCCATTTA
TAGAACTCAAAAATATCCATATCATCCGTAATAATATTCGCTTCCTGCTTAATTCCAATGCGAGAAACGACTTCACAGACAGAATCACGAGTATCAA
TAGCAGGCTTAAGAACTAATACACCCATTCCGCGTTCTTTATAATTATGTGCAGCAGTCAAAAGAGAAGCAGATTTTCCAGCATTCATTGCTGCGTA
AGTAAAAATTAAACTCGCCATATCACCTTCTTAAAGCGTATTCACATAAGCTATTAATTCGTTTTCTTTCTTATCAAACCGATCAGCAAATTCTTCT
TGCTGATCGGGAGATAGCGGGCCGTATCATCATAAAAGGTGTTTGCTTCTGTATGCTCATCTAGAAGTTCATGGATAAGCTCAAACAATTTATCTT
TTTGTTCTTTACTCAGACTCATATATTAATTTCCAGGAGTTTTAAAATAATTCGCTTTTGCTTAAATATTTCCATAGTTAAATGACCAGTATCTTTT
TGACCGATTCCAATGGCAAAACCTTTATTGACAGCGAGTTCAATTAAAATTATCAAGCTCACGTAACACTTCATATTGTAACTCAAAACTATTCATTT
CGGTTTACCTTCTTTAACGAAATCAGGATAAGGATAAAATCCTGAATAAAATCCTTCACCTTTATGATTGATGCATCCTTTATTAGAACAATAGCAC
CAATAATCGAAATCACAAGCCATTTCATCATTACATAAAGCAAAAACAACTGGCCATTCACACTTTTCGCAGTGGGCATTTTTAAGAATACTAGTTT
GGCTCATAACCATGTAACCTTTAAACAATATTCTTCTACATGTTTTACGAACTTGTTTCTATCAATAAAGGTATATTCAACGAATGTTCCAATATAG
TCTTTATCTACATCATGTGGACTATTAATTGGGCATTTAGTACGGCAAATGCGTTCCCATTGACGAATAATTTCCACTTTGTTTTTAGGATCAAACG
GATGCGGGTAATGTACTTTCATAATCCACCACTATTAAATCAATATCAGGAGTAAACATGTCAATTAATTTAGAAACCTTATCCCAATCGCCGCCAG
CAATACCGCAACCTATGCGTGGAATGTAAATTACTGGTTTAAACAAAAGGGTTTCTGCCTGTAGATTTAATTCTATCATGCAGTTTACTAAAGCACC
ATAATCAAGATTAGGACCCGGTTCGTATTGTGTATACAGGTTATAGCATATACCAAATCCCGTAGGACTATGTTTAAAAACAATAGACATATCGCCT
AATTTATCACGAGAACCTATCTCGGTAGTGGTTTTATCTATTTCTAAAATTTTGGGATAGGCTCTTGCTAATTGACCGCTACGCCAGACCCATTG
TGTGGAAGCAATTGCACCCGTGCGCAATAATATTACCTTGAAGAAATAGGGCGGACAATATCGCCCTTGATATATTTTACAATCATCTAGTACTCAAT
CCTCGATTATAAGAATCTACTAAACGGTCAACCATTGAATGACAAGCGGCTTTATCTTTCTCCTCCGCAACTGAACATTCTAAAGTATTCCACTTTT
TAGCATATCGTTTTAACAATGTATCATTTTTATATCTGCTTGATTTATCTCTTTCTCCGTCTTTATATGCATATATTAATTTCTGCGCAAATTCAGC
TTGGCATGCTTTATTTTTCCCACAATAATCCGCGGCAGTACGGTTTACATAATCTCTAATTTCAGTATATGATGTATCTGCTAACACAGAAAATGAA
ATTAATCCTATACATAAACAAAATTTTAGTCATTTACTATTTCCAAAAGTTTATTATTTTTAAGGTAATTAGCCTTTTCTAGGACTTCAGAAGCA
TATTTAGAACCTGCTTTAACATTCCATCCCGAATTATAAGAGGATATCGCCTTTCTTATATCGCCCTTATGTATATTTAACCAATAAGAAAGTTCAA
TGTACGCCCAGGAAGCTGAATTGGACCGTTTATTCAACATTCTTTTTATTTCAGCATCGGTCATATTATAACCAAGTTCCTTAACTCTTGCTCGCAT
AGTAGGCAAATAATTTTGGAACATTCCATAGGCATGATGCTTTGGTTTAGATTTTAAATTAACTCCGGCAGAGCTTTCTTGCCATAAAATAGCAGCC
ATTATATGACCTAATCCGCTCTTGTGGATATTTTGTGTGTTTTATATTTTCCATCCTTAGAAAATTGTTCCCCGAATTGATACGCGTAACGCATGT
TATCGAGTTGGACATTACTGAAAGTATGCTCGGAGCTATGTGCCATCATTGAAATGGCCAATAGACCAGCGAGTAGTGCTTTTCTCATGCTTACCTC
```

Figure 13(P)

```
ATTGAGTTTTAATTACTGCTTTAGAAGCCTTTCCTGGTAAACGACGACTGTTGATAATTGCCATCCTACATTGAAGTGACGGGTCTTTGAACTTTGC
GTTAGGTTTACAAACTGTAAATCCAAGCCAAAGATTTCCATCTGTGATTTCTAAACGTCCAGGACGATATTCAACCCCCTCAATAAAATCCTCGTCA
ATGTCAGGACGCGGAGGCATACTCAGGAATTCATTAACTTCTAAAACATGGTCTTTTATTTTATGGAATAATTCAAAAACATATGTCTCATCAATCT
CCCGTTGAATTGCACGATCAAGAAGATGTTGAGAATATTTTAGATGAAACGATGAGACTCCTGCTGCTTTTGATGCCTCACGAATCTCATTGTTAAT
TTGACGAAACTCCGACTCAAAGTGACGACGAAGCTTATTTCGACGGATAAAAACTTCTGTATTGATAGTCATGTTATTCTCCTCTTAACTGATAGAA
AAATTATACCACAGTCAAGAGGAAAAGTAAACAGTTATTCTTTAAATCTAATCAATTTATTCATAGACTTTGAAACTTCTGCACGAACCTCATGTAG
ATTTTTGAGCTGTTCAAGACGCTGCTCATAGTAAGCAATTTCATCTTCTTCGAGACAGTCCTGTGAATCTTCTTTAAGATAACGTGCATAGTCCTGG
AAAGCGTTACGAACTACTTCCTGGAAGTCATCAAGACTTTGAATTTTCTTAGGAGCAACAGATACACGACGAGGGGCAGTATAATACTCATAACCAA
ACCCTGCGCTTAATTGAGCCATTAGTATTTTTCCTCTGGTTGGAACGCTGCGCGACAAGCCCACATACTGGCTTCTTTGAGTTTCATTTTAGCAATA
GTTAACTGATCGAGGCTTTCGGCGTAATTCTTCGCGAGTTCATCATCTTCACAGCTATCAAATGCTTCCCAGAATTCATCATATAAAGCATCAAAGA
TAAGCCCTAAACGAACTTCAGCATCTTTGATAGCATTCACTTTACTGATTTTATCGTCAGTATGTGGTTTATAACCTTTAATGTCTTCAATCATATT
TTACTTCCTCACCTGTTCCCAAATCATATTCAACTAAACGAATAGGTTCATGAATGCCATATCCTTGAACAGAAATTTCTGTCGTAGGATAAATTCC
ATTAATATCACCCATGTTCCATGCTTCGTTAAATTGCTGTTCGCCTGAATTACTAAACCACTCGGCGAAAGCATTTAGCACATCTTCAGAACCTTCA
ATAATTATCTTTGCCATTACAAACTCTCGGTGAAGGTACGAGCGATAACGTCGCGCTGCTGTTCCGGAGTCAGAGAGTTAAAGCGAACTGCATAACC
GGATACACGGATGGTCAGCTGCGGATATTTTTCCGGATGCTTAACTGCATCTTCCAGAGTTTCACGACGCAGAACGTTAACGTTCAGGTGTTGACCA
CCTTCAATTTTAACTGTAGGCTGTTGCTCAATTTCAATTTCACGGGCATGCAAACCATAGAAAATTTCTGGGTCTACAAAAGAGTCCTCTTTAAAGG
TTTTAGAGACAATAATTCGTGCTTGAATACCATCTTCAAAATAAATAGTACCTTTATGTGTGCCTTCAAGAATTTGATATGCTTTCATATAACCTCA
ATTAGAAAATAAATTTATCCAAGATTGTTCTTTAATTAAAAATGGCTCAGAATCATATGCCATTAAACTCTGTGTGATTAGTCCTTTAAAAGGCCCA
TCAATAAATTCCATGGTAAAATATGGAATTTTATTCATTAGCCGTGACTGAAAAGAACAATAAACTCTGCATCCTTTGAATACGCCTTTTTGTA
ATTTGTATTGCTTGGGATAAAATTCGCTCAAAATGTTATTTTTTGCCAAAATTTCAAAATGATTCACCAATTTATTTTTAATAGTTTTGGCGAAAA
ATAAAGATATTCGAAAAGCTGAGTGTCTGTCATCATTGCATTCCGATTACGAAAAACTGTGGACGAGTAATACCACCAATGCAACATTTAATATTAC
AGCAGCAGTGTACAGTGTCAATATGGACACTATAAATCTTATCCATATCAGGAGATTTGACAGGCTCATCAATTATATACAAAATTCGCGAAAGCGA
TAAACCTCTGAACTTGCTTCCTTTATTACCAATAAAACTGCGCACAGAATCAGTAAATAAACGAAAACGTATATCATCATTAGAATAACGCGAAAAT
TCCTTTTTAATATTATCTGCGGAAATTTTAGCGTAAGCTGAAGTATTAGAAAGAACAATAACTGTTCCACCGTCATACAACCAATTAGCGGCAAAAT
TAGTTACTGCAGTTGATTTACCAGATTGACGCCCACCATCTAGTCGAAGTGTACAATACTGTTTAAGTAAGTCTTCAAATGGCGGGATATATTCGTT
TTTACAAATTTCTTCTACTCTAGCATCAGAATGGTGTGTAAAAGCATTCATCAGGGATAGATAAGGACCAGTTAAAAATGTTCTCATTTTGTTCTCT
CTAGGTTTGGGCCATTCCATGGCGCATGAATTGTCCATTTCTGTATTTACCCATTACCGCACTTGGGCTCGACCTTATTACAGGTTGGCGGGAATCC
CTCACAGAATCATGAGGTCCAGGTTATTCCCATGTTATTTAAATGTAAATATTTTTGCCGTAATACTTATACCAGTGTGGCTTCATTAAAATTTTTT
CATCGAGTCGTTGTTGACTCAACTTAATAGCTGATTTGCATGGATTATAATCATTTTTCCATTCTACTGGAATATGCCTGATGTCAGGAACTTCAGT
ATCTTTTATACTGAACCCGCGTTTTAAGCATTCCGTTATAATGTCCGATTGACGCTTTCGCAAAAATTCTAACTTATCGTAAAAGAAAGTAACATGA
CCAGAACCTAAAATAAATTTAGAAGATATTTTAAAATCTTTAACGCGCTTACCGTTTGCCACATGCTTACGAACTATACCAAAAACACGCGGCAATT
CACGGTATTCTGCGATTAAATGTTGATCAGCAAGTTCAGATACTAAAGTCAAATTAATACGAGTCATTTTATCCCTCCAAGTAACTGTGAATATACT
ATCACAATTCTAGGAGAAAGTAAACAACTTTATAGATTTTTATACGCGTCCCAAGTGCCAGTTCTAAACGTTGCAATGACTCGTTTTGCGCGATTAG
GTGTTTGATTATACCATCTACTTTTAGCTAAGTTAACTGCTGCTTCATCCCAGATAATGTTTTGCTGGAGCATGCGTAAAGAATTAGTAAATCCTGCTAC
GCCGGTTTCCCCCATTTGGAAGACCATGTTAATCAATGCACAGCGGCGAACAGCATCAAGAGAATCATAAACTGGTTTTAATTTAGCATTTCTCAGA
ATTCCGCGAACAGCAGCATCAACATCCTGATTAAAGAGTTTTTCGGCCTCATCTTTTGTAATTACACCATTACAATTACGCCCAATAGCTTTATCTA
ATTCAGATTTAGCAACACTTAGTGATGGACTTTTAGTAAGCAAATGACCAATGCCAATAGTGTAATAGCCTTCTGTGTCTTTATAGATTTTGAGTCT
AAGACCTTCATCTATACGTAACATTTCAAATATATTCATAATACCTCCTAAGTATTTATAGAAGGTATTTATAAATTAAAAGAGGCTGTTCATTATT
CGGTAAAGTGAAGGACCCATCACATATTTCCACTGAGTACGAGGAAAGCATCTCTGGAATCATAACGCCATCTTTATTTTCAA
AATAAGACTCGCAATGGCAATTTCTAAACATCTCATGCTCTACTGGAATCGTATAATAAAATAACTGTAAGTCTTTATTACTAGAATATTTAAATAC
ACCTAAGTCTTCTAGAAGGTCTGGATTATAATCGATAAAACCAGTCTCTTCTGAGCATTCTCTTTTTGCAGCTTCCAGTGCATTCAAATCAGAACTT
TCTACACGCCCCTTTGGAATATCCCAGCGATGTGCAATCATTCCAGGTTTACGAGAACCGGTAACTCGTCCCATAAATAAATCTTTATCTTCTGTCA
TAAAGATAATACCAGCTGATAATGTTTTCATTTTAATTTCCTGCATTCAGTGATAAAATTATTTAATTTTTGAGCATATTTCTTTTCATCAAAAATC
TTTTGTTGTCTGCGTAGCCGCCATGGCATTTCAATGAACGTGTACCATATCCCAGATAATATTGATGCTGTAAAAATATTAACAAGTATGGTTAAAA
GAATCCAATCTTCCTATTCTGTCCATTGGATTTTTTATAAAAAAGTAAAATACGAATGATGACACAGGAAGACTAATGATATACCACAGAATCATAAT
CTTATCTGTGAACCATTCAGCATTCGTTAACTTAGCACGACCATTATGAATACACACGAATTTATCATCTGTTACAGTAGATGGCTTAACTGCTTGA
TATCCCATTCTAAACTCCCTAATTAATCGTTTCTTTGTATCTTCAGAACAGCCGCTCCAGTCAACTCTATCAACTGAAATGCCATCGTCCCCATCAT
CTAAATCATACCAGCGAGTTTTTAAAATCATTTAATTTTCCTACAATCGCTCACAAACTCTTCCATTGATTCTTTTTCAATATAAGACATATAGCTA
TTATATTCCTTTAATTGTATTTTGTAATCCTTTTTCTTTGCCAATTTATTTTAAAATTATCATAATGAAAATATACATGGTACCAAAGAATGAAA
ATAATGAAATCGCTATAGTAAAACGAAGTTCACTCCAAACCTCCTGTTATAATTACTGTGCCGTCGATATTTAAAATAAAACAGTCAATTAACAATCC
AATAAGACTACCCGCAAGAGCTGTAAATACTGATACAGCAAGAATTAATAGTGCCTCAGGAAACGAATATTTGACTTTATTTAGTTTGGCTTTTGC
ATCGTGATTCCTTAACAAATTTCATAATTTCATCAAATTCATACATATCTAGCTTAAGCTGGTGTTCCTTTTTAATCTTTTTACACTGAGCTTTCCA
ATCACGTACACGTTTACGATAATGTCTTCCTTGATACCAGTATCCTACCCAATTTACAGGTACTAATAAAAGCGGAACTACCAATGGAAGAATTAGT
GTTGCTCCAAATATTGCACCAGATTCAATATCAGTCATAACGTCTATAACCATTCCAGCAATCACCAGAATCACAAATGATACAACTACCACAGGAC
CTATTAACACATCAGTAGAAATTAGCTGACGCTTTGGTTCATACTTCACAGGTTTACTTGGAAGGTATAGTGATGGCTTTGACATATTCTTTACATT
CCTTAACAAATTTTTCTAATAATAAATCGCTTTCAAAATTGGGATTTTCTACGAATTTATCAAAAAGATCATCAACAATAGTTAAGATATTCTTTTT
ACTAAGAATACGCTTATTTTCATATTTTGTTTCAGAGTCAACTATAAAAGTAAAGAAATATTCTTTCCCTGAAATTTTACCGTAGTATCAATATAA
AATAAATTTGATTTTTGTAAATTACGTTTAAACCATGCATCACTTAAACTATAAACGCCAAGATAATCATAATCGTCGTTTAAATAACAAACCGTCC
ATTCAGGAGAAATGAAATCAGTAAATTCAACATCAAAATCACACGTCAATGAATGAATTGATTCAATACTGTTAATGAGTATTCCAGGACGTATTAA
AGACTTTTTACCTCTAGAAAATCTTCCGGAAAGCGCTTTCATCAGTTTCATATGAAGACCCCAATAGTAATTACGTCCTTCTGCCATACGTTTAAGA
GCATTTAGTAATTGATCTGGAACATCAACCTGTCTTTGGAACTCTTCAAACATTGAATTGAAATCACTTTGCATTTTCATTCCTATTTACTCCAAGT
AATAGGGGCCGAAGCCCCTTATCATTATTTCAGAGAATTAATATATTCCTGGACATCGGCAGAGGTAGTTTCAACCCCAGAAATATTGCCGTTAAAA
GTTTCAACTCGAGCAAGGGTATCTTCAATATCAACCTTAGTCAGTGCTGCAATTTCAACTACATCATCGGCAGTACTAATTCCAAGGGCATTTGCCG
CACGAGTTTCACGGATATATTCCAATTTAACCGCAAGTTCTTGACGAGCATCATCTAACTCAACTACTTTCTTGGCGATTTCAATTCGCATTTCAGC
ATAACCGTCAGCCTTAGTAGTCAACTGCTCAGCTGTTCGACGATATAGTAAACCGAGTTTAGCATGCATTGTTACATCTTGGCCTTCGGAAGAAGT
TTACGAATTTCACGCTCTTTTGATTCGGCCTGTCGATTCTTTTCGATAACAAGTTCACGAATACGTTTTCTTCGTTAATACATTTAACAGAAGCAG
```

Figure 13(Q)

```
TTTTTAGATCTTTAATTTTATCAAGTAGTTTTGCTGCTGCAGCAGTATACTGTTCTTCGACAGATAGATTTTTAGCCATAGCAGAACCAAGTTTAGT
GCGAATAAACTCAACAATTTTCTTCAGTGTGTTCATAGTATTTCCTTAGGTTAATTGAGATTTAAAATCCGTAGGAGTATAATACTCTATCATCAAG
TTACAGGCTCATAATATCTCAATCATGAGCCTATGTAAACTTATTTCATATTATTAAAATATTCTTCTGCGATTTCGTCGTTATCGTGGTAAACTTT
AGAAGACAGTTTAACATAACCTTCAGCAGTGAACATATTAATCACAACCTTTACAGTATACCACTGTCCGTCTTCATTACCCATTACTGCGTAAGTT
TCAAACATCGGATGGTCAGGACCGATAACTTTAATATCATTCACTGTACGACCAAAATCTTCTGAAACGCATTTCATAAAGAAGTTGAACAGTTCGC
CGTAATTATCCATTTCATTCTCCAAGTTGTTTTTCTGTATCAGTAGTTGATAGTTGTATAGTACCATGGAAGAACAGGGATGTAAACCATTTTGTGA
AAAAAATTTTTAAAAGTTTTAGGGAATTCTAGGGAGGGATGGGCAATTAAAGGATAGGATAATATATTTATAAAGGGTATAAACTAAATGATGCCTAG
AGAGGTCCAGAAAGGCCTAGATACCAAAAAGCCCTATCATTTAGATAGGGATTTAAAATTATTTATCTAGTTTAGTTATTATAGCTTCTGCAGCAGC
TTTTAGCTTAGATGCGGTGTTAATACGATTTTTAATTTCAGTATACGCATCGCCAAGAACATCAAGGCTATCAGAATAAACACTTACACTATTGCGT
TCGCTATTTGAAATAGAACCTTTAGTTTTGCGGTCAAAATCGGTGTACACGTCTTGAAGATCGCGGCTGCCTTCTTTGCATCATCCAATGCATCAA
GAGCTTTATTCAAAGCATTAACGTATTTTTTAGTGTCGAACATATTCTTAGAAATTTTAACAGGTGCGCGTTCAGGAGTAGCTAACACAGATTTAGG
AACCTGAGCGCCAGATGCCAATTTCTTAGAAATTTTGAAAAATGCTTTATTGAATTTATTTTCTTGACTCATTGTAAAAGAACTATTATCGATGTTG
TACATTTCAATAGCTTTAGCTTTCCATTTAAGAAAATCGCCGCGGTCTTTTGGGTCCAATTGGAAGAATACTTTAGTAAGATCTGCTTCAGATGGTA
ATTTTGCTGCTTCGGTTAAAAATTCGGCATAGGTTTTCATTTAAAATCCTTGAAATAATTTATCGGTTGGTTATTAATTATTTATTACTTTGTTACT
ATCCGTAGCAGCATTCTCTATGTGATTCAAACTAAAAAGCCCCAACCTTTCGGTCGGGGCTAAGAATGTCATTTGATTTGTTTAGCAGACCAAATGC
GGTCTTTAATAATTTTTTGGATGTCTTCAACATACTCAAGAGAGTGAACATGTGGATTATCTTTGAAACTATAAGCACGGGCTAACTTTTGGCCTTC
GGTTTTGATTACTAAAAGCTCTTTAAGGATAGCTTCATATTTAGCGATAATTCCTTTAACGATATTTTTTCTTGTGCCGCTTTAGGATCTGCTTTA
GGAGCAGGTTTACCAGAAGCCTTTGCAAAAGCAGCGCCAGTAGCAACTAGACTTTTCCAGGCCATACTAACTGCATTTCCCGTAAATCCTTCTGCTT
TCATGTCGCGAGCAAATTGGAATCGTGATTCGTCAGAAGCATCTTTATAGGAATATTTACCCGCTGCAATGGCTGCTTTTGCGACAGCTTGAATTTC
GGTGCTAGATGCTTCATTTAACACCGCTTCATTTAAAAATTGAGCATATGATTTCATCGTTATTTCCTGTTTTAATTCGTGGATTTAATATACTACTG
TATTTATACTAAAAAGCCCCAACCTTTCGGTCGGGGCTAAGCCTTGCGGCAACCTTGTCGGGGTTCCACCTGCTAAGGCAAGTGTTTGTACGAAACG
CCGGGATTGAACCCGGTTATTAAGCAGTTGACGCTACTCAATATTTTTAAAAGGCCATATCTCGACCATATCCGAACGTTCCGTCAAAACGCTAC
TCGGCTTACGGCAAAGATATTTCCTCGAATCGATAATTCGGTGCGCCGTTTCAGCTGTGATAGTAAAGAACCAGAACATAGTAAAACTGTGGGAGGA
ACTATACTCCAGGGAACATCAGTCCGACGACTTACCGGTAGCGACCCGGTTTCTTAATATTCTTTTAAAGCATCAATATGTTCACGGCATTTACGCC
ATAAATCAATTGCTTCATACGCAGATTCAGCATTTCGAATTGGACGGCATTTATATAAAGACTTGTGATTTTGATATTGCGTAGATAACGGAATTTT
ATCTAAAAGGTCTTTATGTTCAAAGTATTCATAACCATCTAAGCCAAATGAACAGATTTTTAAGAAAATTGCCAATGACCGTATTCGTTTTCGACATAA
ACATAATCTGCATGCTGATAAAGCAAATTAATTACACGTTCAGAAATAACAGTATCATTATGATTAAAATAGAATGTTAAATCATGAACTACTAAAT
AAACATTACCTTTCATATTTTCCTCACTTATAATTGGTCGAGGCAGTAGGGATCGAACCTACGACCTAGGACTTAGAAGGTCCTTGCTCTTCCTTCT
GAGCTATGCCCCGTAATTGGGGTGACCGATGGGAGTCGAACCCATGACTACGAGAATCACAATCTCGAGTTCTACCAACTGAACTACGGCCACATTA
ATACCTACTCCAACAATCAAGATGTCTTCACACGAAATTAAGAGAAGAGTGATCAGTTCAACCCCTATAATCGCGTCAAGTAGATATTAATGTGACA
GTTGTCACAAATTTGGCTGACGTGATAGGATTCGAACCTATAACCAATCGTTCATCGCGATCGCTCTGCCATTGAGCTACACATCCAAATTGGTG
GGGAGTGATGGAGTCGAACCACCCGAGTCGCAATGACAATGGATTTACAGTCCACACCGCTACCCTACGGGATAACTCCCCAAATTAATTTGGTGG
CCCTGGGTGGAATTGAACCACCATCTGGCGATTATGAGTCGCTTGCTTGAACCTTCCAGCTACAGGGCCTTGGTGCTGATTGACGGAATCGAACCGC
CGACCTTCTCATTACAAGTGAGTTGCTCTACCTACTGAGCTAAATCAGCAAAACTGGCGGAGGCGATAGGATTTGAACCTATGAGTCGCCGGAGCGA
CTGCCGGTTTTCAAGACCGGTGCATTAAACCACTCTGCCACGCCTCCAGTCTCCATACAAGGATTTGAACCTTGGACCTCCTGATCCCAAATCAGGC
GCTCTACCAAACTGAGCTACACGGAGTAAATTAAATTGGAGCGGATAATGAGAATCGAACTCACATCATCAGATTGGAAGTCTGAGGTAATACCATT
ATACGATATCCGCAAATTTGGTGCGAGAAGTGGGACTCGAACCCACAAGGAAATCATTCCGCAGCATTTTAAGTGCTGTGCCTTTACCAATTTGACC
ATTCTCGCGCTGGGAATAAAGGACTCGAACCTTTGCATCCTGGAATCAAAATCCAGTGCCTTACCAACTTGGCTAATTCCCAATTATTAACAAAGGC
TCTCAAGCAAGAACCCTTGATGATAGAGGGTATTAATCAGTGCGGTATGAGTTAATAATAACAAATAATTCTTAAAGCAAATTAAACATTTTAACGG
TCGGCAAAACAATTTCTTCTTCTATATAAGAGTATTTAACACTCTCAACTACACGCAAGAAATCATAGTCATAATATTCAGAAGCATGACCAAGAAT
ATCAATAAGGCCTTCAAATATCTTATTACCATTCACAAAGAATAACATCACGTTCTTCATCTTCTTCGGATTTATTACCAAGGTCAACTTCT
ATATCAAAGACCTTTTTAATGAATTCTGGATAAAGTTGTTCTGAGAACAGTCCTTCAACCAAGTATTCATAAATAAAAAGCGATTGCTCGCTGAACA
AGCCATTACCACAATAACGTTCAGCTTTAGTACTAGAATGTCTGCTTTTAAACTTCTTTAAAAGATATTGGAACTGTAAGATTTCATGCTCTTCTAC
GCCAAACAGTGTTTTAGTTTTATAGTTGTCACCATCATTTTCCCAGGTAGTGACATCAATTACGTAGCCCTGCGGAATTGTAGTACCTAAACAAATA
TTCATTTTTCACCATGCTGCGTTAATGTAAGTATATTTAATACATTCAAGACCCAAAGGATTCTTGAAAATATCATATTCAAGAAGACCTTTTTCTG
TTTCAATAAAGAAATCAAAATTTACTGTATTAAATTTACGGTCTTCCTTCACTAATTTAACTTGTGAAGATGAACGGTCAATGTAAACCTTTTCAAC
TTCAAAACATGTTAAAATGCCATAATCATCAATCAAAGCTTTAGCCGCGTCTTGATCATATTTATATCCATTTTCAATGGATGATACTTTCGCATAA
AGAATCATTATCAGCCTTCATCAACAATAGTGTGAGTATTAGCATTTACGATTTGCCACCAATCAAAGCGATTAGAATCCATCGGTTTGTTTTCATT
TTCTTTGATAATGTCACGGAGTTCATCTTCAGAGAATGCTTTAGCAATTAAATCGGTATACCCACCACGGGGATAATAATTATCACCTGCAAACAAA
AGGAAATTTACCTTCCCGGAAGCAACATATGCTTCCTTAGGATACTTGTTTCCTGCGTGGTCAACCACTTCAATATAACGGTAAGGAATATCGGTTC
TTTCAACCCATTGCCATGCCGCCGCAGGGGAATCGAAAGCATCTACACCTAAACGATTATCTTCATCTTTAGACGGATTATTTTCGTAATCCGCATA
TACATAATATTCAACGTTCATTATTCACCTTTAGAAATTTTTATCCATAACAATAGCAATTAAAACAATTAAAAGTGCTACTACAAGTGAAAAAACAT
TTTCTGCCGTAGTCAATAATCCGCATATAAATCCAACAAACATTGAAAAACTGAAAGCGGAAGCAGAAATTGCAATAGCAACATTTCGAATTAATTC
ACAACGTTTCATTTTATTCTCCTCAGTAGTAGATAGGGTAATAGTATCACTACCCTATCTAAAAGTAAACTTATTTTTTACGAAAAATTGATTTATT
TTCTGCTGCCCATTTTTCAATAACTGCAGCAGGACCAGTAACAACAATTTTATCACCGTAATCTTCTGCGGCGAGTTGACCGAAATTATCTAATGCA
TCACGAAGAACTCCATGAGGCATTTCACCCATTTTATCTTTCTTGCCAGTGTAAATAAACTCAACTTTTACATCAGCAGTTTCAGCAATAAATTCTT
GGTAAGTTTTCATTTTGATTTCCATTTGGTTTTGTTTTGATAGGGTAATAGTATCACAACTAAAACCCTATGTAAACAACTTTGTGAAATTATTTTA
AATCTTCTAATCGTTTCTTCATCTTAGAACCATTTTTAGCAATTTCTCCTGCATCGGAGCATAATGCTAAAAGTGCTTTAACTTTAGTTTGGTCTCC
TTTAAAGATGAAGGATCTGACCGCAGCAGCAAGTTCTTAATACGAGAGAAAAGACGCTCAGCTTCAGCTAAAGCCATTCCAAGCTTTACTTCCATA
CCGTGGGAAGATTCAGTGATAGTAGTTTTTATAGCAAACTCTTTGAAAGTTTTCATTTTTATTTTCCTAATTAATTTTGATGAGGTAATAGTATCAC
TACCTCATCAGTATGTAAACAACTTTGTGAAATTATTTTAAATCATCTGCCCAATCGAGTTTAAGAGGCTCTTTGTATTCACGGTCAAGTACAACCG
GAATTTGTACATCACCGCTAAATGATAAGGGCCCAACATTATAAGACAATGTTATATGCGGTGTAATCATCAAAATCGTGTAGCACCTAGTGC
CCGCGCATACATGTGTCGACAGCGCAGATATTCAGAATCTAGCACAAGTACAAGAGTCGATCCATCTTGTGTTTTCCACACTTCTAAATGTCCAGAA
GAAGCTACTTCAAAACTTCCACTCGATGGAACATATGGAACATTTACTCTCGAATAACATATGGTCGAATGAATTTTTTCTAGGAACTGGATTAG
GAACACGTAAAGAGCGCTGGAGTTCTTCCAGCGCGTCAAGTGTTAATTCTGAAAACTTAGCTGCTACATAAAGACCCGTTGAAAAGTCTTTAAATTC
CATCATTCTTCATCTGCAGATTCAGCAGTAAGATTCTTGACAGCTTCAACGATTTCTTCAACTTTAATAGTATCGCCAGTGATACCTACTGCATGAG
```

Figure 13(R)

```
CAATTTCAGCCAAAGTTCCTTGCAGAATTTTGGATTCTTCCATCAGACGAGCCGCTTGGTCCTGCGTATCAAGAATACGAGATTTCAGAGTTACGAT
TTCAGCAGACAGTTTTTGTTCAATAGTTTGTTCAGACATTATAGTACCTTTAGTGTATTTTTAATTTTAGAAAAAAGTTCTTCAAGAGAACCATCGT
TTGTAATTACTAAATCGCCATCACGAATTGGCAATCCAGCTTCTGTAATATGTGTATCATTGGATTTTTGACCAGGACGAACTACATGAATTACTGT
AGCACCCATCGCCCTAGCCGCATCCATTTCATGATCTTGACGGGTATCAGGAACGATATAATAATCATAACCTGAGTTAAATTTATCAAGATAATCT
AAAGCAAATAATTTTACCCAGTACATGCGGTCGAAGTTATTAACAATCAAATCCGTACCTAGGGCTTGCATCAGACGACGGACTGACCATTGATCTT
CAATATTATTTATAACGTCAGTAATTTTGTTAAATGCTACGAAATTAACTGATTCTTTTCCTTCGTCATCAAAAACAAACACACCTTTAATTGGGCT
TTTACCATTAAGATAGCAAAATGCTTGTTCCATAATCGTGATTACTTCTAATTTAGTCAGATTTAAATTAGTCTCACGATCATAGTCAATTCCTTCA
AACTCTTTACGAGTTAAGCAAGGATAGTCGGTGTTTGCTGCAAATACTCCCCATGCATAAGCCAATGCATCCTTAATAGGACCAGCAAGTTGGTATT
TAACTGCAGAATAATTACTCATGATAAAATCAGCAGTAGTATCTTTTCCACTACGCTTTACACCGCTTAAAAAGATTAGTTTCATGTGTTTCTCCTC
AAATTTAATTAAGATTATAACACACAAAGCTGAAGCATTAAACTTCTGCTATAATTTTACCATCTTTTTCTACTTGAAAATAGGTGTAAGGAATCGT
TGCTGTACATACTAAAGCCGGGTCTGAATCTTCCGTGTAGCTAAATTCTACTTCAGATAGGTCAGAAACCCAAGGCTTATAAAAATTTATTGACATC
ACGATTTCAGTTTTACTATTATCTAAAATGTAAAGCGTAATGTATTCAGGACCTGTTTTTTGGGCAGTATTTTCGCCTGTAAGATAGTTACTAGTTC
CTAGCATCCATTCATACATTCCTATCCACGACTTAAGCTCTTCGTCAACTATAAATCTCACGATGAGTGGATCGTACTCAAATGTAACACCTGGACG
TTGTGCTCGACCAAGTCCAAACGGCCCAGTCACGGTATCAGTAACAGGTATTCTAATTCCTGGAATAGGAACTGACTGAGCATTTAAAGTAAAAGCA
GATGTAGTATTACTATGTGGTATTGATACTACAAAGTTAGTTGTATTTGCTTGGTTAAAAATTTGTTGCAGTGCTTGCGACATATATTCCTCATAAT
GCTTTATAAATGTTGGTGGTATAATGGGTCTAAGTCCCTTCCATTCAATTCCAATTAGAACAAACAATAGAAAAGAATGGAAGATAATAGAATTAGA
TATTTGACCAGACTTTGTTTGCAGAGAAACGTTTTCCTTTTGAAACGAACTGCTGAAGTGGCATTAACACAACGTTCGCCCAGTCTTTCGGGGCGAT
TTCAACAAGGCTACCCATAATATTACCGGGGATATATGCCTTAATCATTTGGTCTGCACCCCTAAATCCTTTCACTTGACTCCAATCAATTTTTAAT
TTAGTTTTATTAGTAATAGTAGGTGTATTTGAATATTGCTTTAAAAAGCTCTTCTAGAAATTGCTGACGAGCTTTAGGTGGAATATAGTGCAAGTTTA
ATCCGTACATTAAATTATGTTTACCTAAACCAAGGTAAATTATTAAAGGAAATTTATCCCAGTAAGGAAGAGTTTCCTTGTGTTTAGCATCATAAGC
AAAAGCATATATTCGTCCCGGCTGCGGGCGAACAACTTTATGTCCTTTTACTTGCTTAATAGTTTCAGCAAACCACTTTCTGGTTTTATTATTAATT
GCTGCGCCTTCATTACGAATTTTATCACGCAATGTTTGTCTGAATGAATTTATCATAAGCAGTTGTCTTTCTTGCTTATTGAGTTTATTCATTGGTT
TTGATTCAAGCTTTTGAATCTTTTCAGCCGTTTTAATTCCTGAAGCATATTTTGACATTGCCGAAGTAAACGTAGAGTATTTGATTCCTCTTTCTTC
AGCAAATTGCTTTCCTGTCATTCCTTTTGCTTTGGCCTTTCTGTATTCAAGACCTATCTGAATCCATTTCTTTTCGTTTAATGATTGCTTAACCTTT
GGAACTTGGGGAGTGCTTTCATTAATTATTTGAAAAATAGCCATTATGCCCCCTTAAAGCCAAGAGCTCGTAATCCATCTTCTGTTAGAATTCTAAA
TTTTATTCCACGCTTTTCAGCTAAAGATTGTGCTGCTTTCCATTTGTCGGTATTAACAGATATGTATAAATTTCATTCATAAATCTTTTCTTCGCT
GCGGTTGTTAGATGTGCTGGTTTAACTGGTGGTTGTGTTTCTTTTTTAGGTTTTATTTCAATAAAAAATTCTTGTCCAGAAGAATCTTTCATCCAAA
TATCCATGAAGTATCTACGTTTTTCCCTTCTGCATTACAAAAATAAGGAATTACTGCTGTTTCACTACCCCATGCAATAATTTCTGGATTTTTATC
TAACCATTCAAAAAGAATTTTTCCCAATTTGATCTATACGTAATTTTTTTAGGGTCACCTCTATACTTTGATATATTTTTAGGAACCCATTTTCCA
GAATATGCCATTGGATTCTCCTTATAAATAGATAATATATTTATAAACAGGAGGCCCATGCTCTTTACATTTTTTGATCCGATTGAATATGCGGCC
AAAACGGTGAATAAAAACGCGCCGACTATTCCTATGACAGATATTTTTAGAAACTATAAAGACTATTTTAAACGCGCTCTTGCGGGATACCGCTTAC
GTACTTATTATATCAAAGGTTCACCACGCCCGGAAGAATTAGCAAATACTATATATGGAAATCCGCAGTTGTATTGGGTTTTATTGATGTGTAATGA
TAATTATGATCCGTATTATGGATGGATTACTTCGCAAGAAGCTGCTTATCAAGCATCTATACAAAAATACAAAAACGTAGGTGGAGACCAAATAGTA
TATCATGTGAATGAGAACGGTGAAAAATTTTATAATTTAATATCATACGATGATAATCCATATGTTTGGTATGACAAAGGCGATAAAGCTAGAAAAT
ATCCTCAATATGAAGGAGCACTTGCTGCGGTCGATACGTATGAAGCTGCTGTTCTTGAAAATGAAAAACTTCGTCAAATAAAAATAATAGCAAAATC
AGACATCAATTCATTTATGAACGACCTTATACGTATAATGGAGAAATCTTATGGAAATGATAAGTAATAACCTTAATTGGTTTGTTGGTGTTGTTGA
AGATAGAATGGACCCATTAAAATTAGGTCGTGTTCGTGTTCGTGTAGTTGGTCTGCATCCACCTCAAAGAGCACAAGGCGATGTAATGGGTATTCCA
ACTGAAAAATTACCATGGATGTCAGTTATTCAACCTATAACTTCTGCAGCAATGTCTGGAATTGGAGGTTCTGTTACTGGACCGGTAGAAGGAACTA
GAGTTTATGGTCATTTTTTAGACAAATGGAAAACTAATGAATTGTCCTTGGCACGTATGGTGGAATAGTTCGCGAAAAACCGAATAGACTTGAAGG
ATTTTCTGACCCAACTGGGCAATATCCTAGACGTTTAGGAAATGATACTAATGTATTAAACCAAGGCGGAGAAGTAGGATATGATTCGTCTTCTAAC
ATTATCCAAGATAGTAACCTTAGACACTGCAATAAATCCCGATGATAGACCCACTATCAGAGATTCCAACCGATGATAATCCAAATATGTCAATGGCTG
ACATGCTTCGCCGTGATGAAGGATTAAGACTAAAAGTTTATTGGGATACTGAAGGATATCCGACAATTGGTATTGGTCATCTTATCATGAAGCAGCC
AGTTCGTGATATGGCTCAAATTAATAAAGTTTTATCAAAACAAGTTGGTCGTGAAATTACTGGAAACCCAGGTTCTATTACGATGGAAGAGGCGACG
ACTTTATTTGAACGTGATTTGGCTGATATGCAACGGGACATTAAATCACATTCTAAAGTAGGACCAGTCTGGCAAGCTGTCAACCGTTCTCGTCAAA
TGGCGTTAGAAAATATGGCATTTCAAATGGGTGTTGGCGGTGTAGCTAAATTTAACACAATGTTAACTGCTATGTTAGCCGGAGATTGGGAAAAAGC
ATATAAAGCCGGTCGTCGATTCATTGTGGTATCAACAAACAAAAGGCCGTGCATCCCGTGTTACCATGATTATTCTTACGGCGGAATTTGGAATCATAT
GGTGTTGAAGTGAAAACCCCAGCTAGGTCTCTATCAGCAATGGCTGCTACTGTAGCTAAATCTTCTGACCCGGCTGACCCTCCTATTCCAAATGACT
CGAGAATTTTATTCAAAGAACCAGTTTCTTCATATAAAGGTGAATATCCTTATGTGCATACAATGGAAACTGAAAGCGGACATATTCAGGAATTTGA
TGATACTCCTGGGCAAGAACGATACAGATTAGTTCATCCGACTGGAACTTATGAAGAAGTATCACCGTCAGGAAGAAGAACAAGAAAAACTGTCGAT
AATTTGTATGATATAACCAACGCTGATGGTAATTTTTTGGTAGCCGGTGATAAAAAGACTAACGTCGGTGGATCAGAAATTTATTACAACATGGATA
ATCGTCTTCACCCAAATAGATGGAAGCAATACAATATTTGTACGTGGCCGATGAAACTAAGACAGTTGAAGGCAATGGAACTATCCTAGTTAAAGGTAA
TGTTACTATTGTAGTTGAAGGTAATGCTGACATTACAGTTAAAGGAGATGCTACCACTTTAGTGAAGGAAATCAAACTAACACAGTAAATGGAAAT
CTTTCTTGGAAAGTTGCTGGGACAGTTGATTGGGACGTTGGTGGTGATTGGACAGAAAAAATGGCATCTATGAGTTCTATTTCATCTGGTCAATACA
CAATTGATGGATCGAGGATTGACATTGGCTAATATACTTCCAATGAGCGCTGATTTAGGAGAATCCATGGAAGGTTCTTCTATCGACGTCACCTTTA
CCGCTCAATTAGAAACAGGTGAAACGTTAGTATCTATAAATATAACCTAGGTGAAGAAACTCCTGGGTTTTTAGTAGAAGAAAATCAGTTTATACGG
AACATATGAATCTGTGTTTGGATTTGGAAATGACGCGTTGAAATATCGTTTAGGCGATGAATTTAAAACTGCTGCTTCATGGGAAGAACTTCCTACT
GATTCTGATACTCAGTTGTATTTATGGAAAGCTCCTCAAAAACCTCCAGAAGACATTCACTTACGAAGTAACATTAATATATGACTACCAAGAACAAA
GTGAATCTGGAGGTTCTGGCAGTAATTCTAGGTCATCTTCTGATACTACTGAACCGACAGATCCTCCTGCTCCAGTAAGAAAAACTCTCGTTAAAAA
TTATACTAAAACTATAGTTGGAAATTTGGAGTCGTTGGGCTAATAAATTAAGAAGCTATGTGTATGAGAGGTCATAGATGTCAGGATTAAGTTATGAT
AAGTGTGTTACTGCCGGCCATGAAGCATGGCCTCCACACAGTTGTGAATGCTACACAAAGTAAAGTATTCACTGGAGGAATTGCTGTTCTCGTAGCAG
GTGATCCAATTACAGAACATACAGAAATTAAAAAAGCCATATGAAACACATGCGGAGTGACACAACCTAGAACTTCTAAGGTATATGTCACTGGAAA
GAAAGCGGTTCAAATGGCTGATCCAATATCATGCGGTGATACTGTGGCTCAGGCATCATCTAAAGTATTCATTAAATAGGATTTAAATGCAAATA
CCCCTGTAAATTATCAATTAACAAGAACAGCAAATGCTATTCCCGAGATATTCGTCGGGGTACATTTGCTGAAATAAAACAAAACCTCATTGAATG
GCTTAATGGCCAAATGAATTTTTGGATTATGATTTTGAAGGCTCAAGATTAAACGTTCTGTCGCGACCTTTTGGCTTATAATACGCTGTACATTCAA
CAGTTTGGTAATGCTGCTGTGTATGAAAGCTTTATGCGTACTGCTAACTTACGAAGTTCAGTTGTTCAAGCTGCACAAGATAACGGATATTTACCTA
CTTCAAAATCCGCTGCGCAGACCGAAATTATGTTAACATGCACCGACGCATTGAATAGGAATTACATTACTATTCCTGCGGAACTCGCTTTTTAGC
```

Figure 13(S)

```
ATATGCAAAAGATACTTCTGTTAATCCATATAACTTCGTTTCTACCGAAGACGTTATTGCTATTCGTGATAAAAATAACCAATATTTTCCGCGTTTA
AAATTGGCCCAGGGACGTATAGTAAGAACTGAAATCATTTATGATAAATTAACACCTATTATCATTTATGATAAAAATATTGATAGAAACCAGGTTA
AATTATACGTTGATGGAGCAGAATGGATTAACTGGACAAGAAAGTCAATGGTTCATGCTGGTTCTACATCGACAATTTACTACATGCGTGAAACTAT
TGATGGAAATACCGAGTTTTATTTTGGTGAAGGTGAGATTTCTGTTAATGCGGCAGAAGGAGCATTGACCGCTAATTATATTGGAGGTCTTAAACCT
ACTCAGAACTCTACGATTGTTATTGAATACATCAGTACTAACGGTGCAGATGCGAACGGCGCAGTCGGATTTTCATATGCAGATACATTAACAAATA
TAACTGTCATCAACATTAATGAAAATCCAAACGATGACCCAGATTTTGTTGGGGCAGATGGCGGCGGCGATCCAGAAGATATTGAACGTATTCGCGA
ATTGGGTACTATTAAACGCGAAACCCAGCAACGCTGCGTAACTGCGACTGACTATGATACATTCGTTTCAGAGAGATTTGGTTCTATTATTCAAGCA
GTTCAGACGTTCACTGATTCTACTAAACCTGGTTATGCATTTATTGCTGCTAAACCTAAATCAGGACTATATTTAACTACTGTACAGCGCGAAGATA
TTAAAAATTATCTCAAAGACTATAATTTAGCTCCTATTACGCCATCAATTATTTCTCCTAATTACCTTTTTATTAAGACTAATTTAAAAGTCACATA
TGCTTTAAATAAGCTGCAAGAATCCGAACAGTGGCTCGAAGGTCAAATAATTGATAAAATTGATCGTTATTATACCGAAGATGTAGAAATTTTTAAC
TCATCTTTCGCTAAATCTAAGATGTTGACATATGTAGATGATGCAGATCATTCTATCATTGGCTCATCCGCGACAATTCAAATTGTTCGTGAAGTAC
AAAAACTTCTATAAAACGCCTGAAGCAGGTATTAAATACAATAATCAAATAAAAGACCGTTCTATGGAATCTAATACGTTTTCATTTAATTCTGGACG
AAAGGTTGTAAATCCTGATACTGGTTTAGAAGAAGATGTATTATATGACGTTCGCATAGTATCAACAGACCGAAATTCTAAAGGAATTGGTAAAGTT
ATTATTGGTCCATTTGCTTCTGGCGATGTTACAGAAAATAAAAACATTCGTCCATATACAGGAAACGATTTTAACAAATTAGCAAATTCTGATGGAC
GCGACAAATACTATGTTATCGGTGAAATAAATTATCCAGCTGATGTGATTTATTGGAATATCGCTAAAATTAATTTAACATCTGAAAAATTTGAAGT
TCAGACCATTGAATTATATTCTGACCCAACCGATGATGTTATCTTTACTCGCGATGGTTCACTGATTGTATTTGAAAATGACTTACGTCCACAATAC
TTAACTATCGATTTGGAGCCTATATCACAATGACAGTAAAAGCACCTTCAGTCACTAGTCTCAGAATTTCCAAGTTATCCGCAAATCAGGTGCAAGT
ACGCTGGGATGACGTTGGTGCTAATTTCTACTATTTTGTAGAAATCGCTGAGACAAAGACAGACTCGGGGGAAAATCTCCCGAGTAATCAATATAGA
TGGATTAACTTAGGATATACTGCAAATAACAGCTTCTTTTTTGACGATGCTGACCCATTGACATCATACATTATTAGAGTAGCTACAGCTGCACAAG
ATTTTGAGCAGTCTGATTGGATTTATACCGAAGAGTTTGAAACTTTTGCTACAAATGCTTATACATTTCAAAACATGATTGAAATGCAATTAGCTAA
TAAATTCATTCAGGAAAAATTTACTCTTAATAATTCTGACTATGTTAATTTTAATAATGACACTATAATGGCTGCATTGATGAATGAATCATTCCAA
TTCAGCCCATCATATGCTGATGTTTCATCAATAAGTAATTTTATTATTGGTGAAAATGAGTATCATGAAATACAAGGTTCTATTCAGCAAGTATGTA
AGGATATTAATCGAGTTTATTTGATGGAATCAGAAGGGATTCTATATCTTTTTGAGCGTTATCAACCTGTAGTTAAAGTATCCAATGATAAAGGTCA
AACCTGGAAAGCTGTAAAGCTCTTCAATGACCGTGTAGGATATCCTTTATCTAAGACTGTATATTACCAATCTGCGAGCACAACATATGTTCTAGGA
TACGACAAGATTTTCTATGGCCGCAAATCTACTGATGTTAGATGGTCAGCTGATGATGTCAGATTTAGTTCGCAGGACATAACATTCGCTAAACTTG
GTGATCAACTTCATTTGGGATTTGATGTTGAAATCTTTGGTACTTATGCTACATTACCTGCAAACGTGTATCGTATAGCTGAAGCTATTACTTGCAC
CGATGATTACATTTACGTTGTCGCCAGAGACAAAGTTAGATACATAAAAACGAGTAATGCACCTATAGATTCTGATCCATTATCTCCAACATATTCG
GAAAGGCTATTTGAACCTGATACAATGACTATAACTGGAAATCCTAAAGCAGTATGCTATAAAATGGATTCTATTGGTGATAAAGTTTTTGCTCTTA
TTATCGGTGAAGTTGAAACATTAAATGCTAATCCTAGAACGTCAAAAATAATTGATTCTACTGATAAAGGAATATATGTTTAAATCATGACACAAA
AACGTGGAAAAGAGTTTTTGGCAACACTGAAGAAGAAAGAAGACGTATTCAACCTGGGTATGCGAATATGTCAACTGATGGTAAATTAGTTTCTCTA
TCTTCGAGTAATTTTAAATTTTTAAATGATAACGTTGTTAATGACCCTGAAACTGTAGCAAAATATCAGTTAATCGGTGCCGTTAAATATGAATTTC
CTCGTGAATGGTTAGCTGATAAGCATTATCATATGATGGCATTTATAGCAGATGAAAAGTCTGATTGGGAAACTTTTACGCCTCAGCCAATGAAATA
CTACGCAGAACCGTTCTTTAATTGGTCTAAAAAATCTAACACACGCTGTTGGATAAACAACTCTAATAGAGCTGTAGTAGTTTATGCTGATTTAAAA
TACAC
```

Figure 14(A)

K2 contig 1 (no luciferase insertions)(SEQ ID NO: 1)

```
ATGTGTTTCCAGAAAATTTCTTCTTTAACTACATCATCTTTACGAGTATCGCCTTGTTTGCGTTGGATATGCAAATTAAACGGAATATCGTTTTGTA
AAAGCCACTCACGTGTCATAACATAATATTTTAACTTAGCATTTTCGGTGCCAGATTCACGTCCGCTTACAGTAATAATCTCATAACCCGAGTGATG
AAGCATCTTCAGATATTGTACAACCATTTCGTTTGTGTATCGGTTGATAATTTATCTAATTCGTATGGGCCACGAGATGTATGAATAGCTAGTGTT
CCATCAAGGTCAAAGATTGCAGCTTTTGGTTTACCAGGAGTCCCTTTGTATACCGGAAGACCGAGATACTCTCGCATACTTTTATACATTGAGCGTA
AAACATCAATTGGTACTGCTTTAGTTCCACGTTTTGAGTTACGTTTAACCAATTCAGTCCAAGGAACATCAAACACTTTATATTCAACTTTCCATCC
GTATTCTTTGGCAAAAGTTTCCCATGCTAGGCGACGTTCAGGATTCAAGTTAGTGTCTGAAATAATTACTCCCTTGACAGAATCACCGCCGTACAGA
ATACTCTTCGCGGTATCAAACTGCATACCGGTCACAATGCCTTCTTTCTTTTTGGTATACTTGTACTCGTCAGCGTTCTTCATGACCCATGATGGATT
GACGATAATCATCACGATTGATATTATAAAATCCAGGATTTTTAGCAATAAATTCACGAGCCCAAGTGCTCTTACCTGAACCAGGACAGCCAATAGT
TAAAATAATCTTTTTCATCATTTAATTCCTAAGAAAACTTCAAGAATACGAATATTATGCTCACGTCGCTCTTTATACACTTCAGCTGTTGATTGAT
TCACTGATTTGCTCTGAACATTAGATGAAATAAATTTTATCATGTGATTTTTAAGCTGATACATATCAAGTCCACGAGCTTTTGCTTCTTTTCGTAG
AGCTTTACCAGCGTCATCTAAAGCTTTCGTAGGGTCTTCATCATTTAATACTATTCCACGATCCAAATCCATGTATACTGCACCATGACATGCATCA
ATGTAAAGGTCTGAGCATTCAATATAACGTTCTAACAGAGTTTTTCATTTATTTTTCTCAACTAATGATTGAATATAATCATGCAGGTCTTTAGATGC
TTTACCCCACTTATTTTGATATTCATTTTTGAGATTAGCACGGGATTGAGCTAATAAAACATCATTAGTTGGAGGTAAAGATTCTAACCGCTGAATC
TGGCGTCCATAAATCATTGCAGCCATCTCGGATTCATAAATCAATCCTTTGAGATGTTCAAATTGATGCCATGAAATCATTTACATTTATCCTCTTT
TAACTCTTGACGATAATAACATATCATAGTTTTTTGGTCATGTACATATCGTTTTACATCATTAAGCCAAATACGAAATTCCTGGGAATCTTCAAAT
GACATACCGACCCAAGCTTTACCATCAATAACTTTAACTTGCCAAGATAGTTTAGCTTCATCATATGACTTTATCTGTACAGGCCAATTAGGATGAA
CTGTTTCTTTCTTTACTTCTAGAGGCTTTGTCGAACAACCAACTAGAAGACCAATAGATAATATTACTGCTGATAGTTTAATCATTTAGAAAGGTCC
TGGATGTCTTCTGCGAACTTGTTGAAGGAGTTGTTGATTTGTTTTTCGAACCAATCCTGGCTTACGAGCCACCACATCCGCTTCTTTGCATCTTTGC
GCAGTTTTTCATTTTCACGCTCAATAGCAGCAATCGCCTCACGATTTTTATTATTCATCGCATCAATATAATTATACTGAATTCGCAAATTATTTAA
TGCTAAGGCGTTTTCATTGGCCGTTTTTGTAATTTCTACAACAGACGTTTCTAATCTTTCAATTTTATTTTTAAAATTAAAGAAGTTCCGCCTAAT
GCAATTACAATTAATAGCAAACCTGCTGTCGTATTACTTAATTGCATAAAGTTTTAATAACCTCTATAATATCGTCTTGAGAAAGACCGTTAATTAA
AATATGATGTTCAGCCGGAGATTTAGAAATTTTAAAGCACGCCGCAACATCTTCTGCCATATCCGATGCGCTACGATTTGGATTACTAATTCCAAGA
CGATGTTTTCCCGTTAAAGGATTAACGATGATATAGCATTTACAGTTGTTAATATGAACATTAGGTTGAGTCTGATTAATAAACACTTCACAATCAT
ACTTAGCGAGTTGATTTTCTAAAAAGACTTTCATCTCCTCAACCGCATCAGGAAGCATATCACGGGCTTGCTCAAGACGACGATTTCGATATTCTTT
AATGGTCGTTTTCCGCTTGACTTGCTTAGCTAAATCTTTCTTAAGATCGGTGATATATCCAACTCGACGATTTCCTTTAAATACAGAAATCCCATCT
GTAGTATCACCGTATGCTTCAACGACCATTTCAGTAGTAATAAGCTGTAAATCCATCATAAAGTCCTCATGTTATGTCAGTAAGTCTACTATAACAC
AACACGAGGGGTTTGTAAACAGCTTAGTATCCTTCTGGGATAAATTTTTTATAATTTTTCAAAAAATTCTGTTCGATTTCACACATGACCTTTTCTT
GACTATCGTACCCCTGGTATAAGCTCATGATGATACCGAACAGATGTTCCATTCCAGCACCTTTAGCAACGCCTTGCGCTTCCATTGCATAAGTCTT
TCTATCCTTACCACAATGTTTATTGTGACAGTCAAGAACTAAAAACAGAGCTCGGTCTAAGTACTTCAGATAAGTCGTTTCAAACGCCTCAATTTTT
CTGTATGAATATTCATCATCAGCGTACATTGCTTTAAGATCATCTGATGCACCATCAATAATAGTCTTAAACAGTTTTTCTGGATTGTCTAATGAGC
TTTTTGTACTATGAAGAGACACGTACCAGTCAGACTTAATTTTAAAATGAGAACCATCTTTCATCCAGCAACATAGCCTTCGATGTTTTCCGCATT
TTTAGCTTCTTCTACCCATTTAGGGCTATCGATTTCGTATCGTTCAACTAGATATGGACGAAGAACAGCATCTTTATAAATGTCATCATATGAAATG
TATTCACCTGTTTCATTTTCACGAATATTCAATAAAATGATTTTCACCTCTTGATAAGCAAGAACGATTCTATTAGTTGGAGCGACGAATTCGAAGT
TAGCAGTAAATCCATCTTCAGCTAATTCTTTAAGTCTATCACGCAACCGATGGTGATTAATATTCATCAAAATACCATTAGCCATTAAAGCCTGTTC
GGATTTGATTGAACCCTTTGATTTGAACAGAATTTCATCACCATCTAAATAAGTTGATACCAAAGACCCATCTTCCTTTGTCAGAATGTAATCAACA
TCATTTAAATCGATATTCATCGTGAATGGATTTTCATTTAAGTTAAAAAACTTTTCCATAGGACGAGAAGCAATTCTTACTGGTTTTTCTCCATCCA
TTTCAAACATGATTCCACGACATTCCAATGCATCTGGAAGTAACCAATCAGAATAAGATGCATAATTATATGAGAAAATTCTGTAAGTTCTTCCAGA
TGCACTTACATCATCTGAGTAAAAAAACTTACGCTGTGAATCCTTACATAGTTCCATTAAATTGTTAAAAAGTTCTTGCATTGTGTATCCTCTTTTG
TGTTTTGAATATAGTACCACACTCCATGTGGAAGCATCATTTTTTCTTATGTTGAATATTCCAAGGCGGGTTAAACAGCTTAATGAATAGTGGTTCC
TCTAGGTCAATCGTCGCGATTGTCATTGTACCTAACTCATTTGTCATAGAAAGATTAAAACATTGGCGGCGTAAAATTCAACTTTGCTTCCTTCCT
TTAGCGCAGAATGAATTAATGCAGATTTAGTAGAATCAGACGTTTTGTCTTTACGATTAATAACAGTTCTATAATAGTTTATTCTTTTACGTAAATT
TTTAGTTTTTCCAATATAAACAAGCTCATCATTTATAGCAATAGCATAAATTACGTTATACTTGTTTGGAATAGATAATTGTTTTATACTTCCGTTG
TCGTCTAATTCTAGCTCAGTATATTTAATAAATGAATATTCTGTTGCAATTTCTTTCATAATAAAATGGGCCTTGCCGGCCCACTCCTTAAAAGTATT
TTTTAAAACTCATCATAACTTTATCATCAACATCATTATCAATCTGTGCAACAAGATAAGATGACAGTTCTACTTCTTGCGGCGCGGATTGAACATT
ATCAGAATTAAGGTATTCACGAATCCAAGGATATGGATGTTTAACCGGAGCACCGGTAATTGGGCATGGAAGACCACACTGTTTCATACGAGATACA
GTTAAGTAATCAATAAAGCTCCACATGCTATTTGTATTTAATCCAGGAACATGCCATCTTTAAATAAATGAACTGCCCAATCTTTTTCTTGGCCGGT
TAACTTCCATGAAAATATCAACTGCTTCTTGNTCNCACTCTTTGGCAATTTTAACCCATTCATCACCATCAGTGCCAAGTTGAAGTTGACGAATAAT
ATATTGTGTACCTTTAAGGTGGAGTTGCTCATCACGCGCAATAAATTTCATAATCTTCGCGTTACCTTCCATGATTTCCATATTCTTATGGAAGTTG
AAAGTACATGCAAAGATACATAAAAACGGATAGCTTCCAGGGCATTGATAACGTGCAAGCAGAGATAAAGCGACTTCATCAGGTCACGTTTACAAC
CTGCAACATGGTCAATAGCGTCTTGGACAAGTTCTTCATCATGCTCTGTTGCCAGGTAGAATTCTACGTCAGCTTTAGCGTTTTCCCATTCACGAGT
CTTTACCAGAACATCATCATAATAACGACCAATCGATTCAGCACGTTTCATGATTGCATCATCAAGAATAATCTCATCAAATACCTTGGCAGGGTCA
TTGAACAGGTTACGCATGATGTGAGTATAAGAACGTGAGTGAATAGTTTCACTGAATGTCCAAGTTGCAGTCCATGTATCTAATGACGGGTCAGAAA
TCAATGGCATCAGTACTGCTGCAGGAGCACGTCCTTGAATACTATCTAACAATGACTGATATTTCAGGTTGTTAGTAAAAATATTTTGCTGATACTG
AGGAAGCTTATTAAACTGTGCAGCATCCATCATCAAGTTTACTTCTTCAGGACGCCAGAAAAATGATAATTGCTTTTCGGTTAAATCTTCAAAAACT
TTATGACGTTGAATATCATAACGTGCAATACCAAGACCTGAACCAAAAAACATAGGTTCTTTTAAAACATCAACTGGATTTGTATTAAAAACTGTGC
TCATAAATTTTCCACTTAGTTAATAGTTGGTGACTCGTCCATGAGTCAAATTATATCATAATTTACAGGATGAACAATCTTCAGCTTTTGGAGTTTC
TATTTCATAATCATCAGTACCAGAACCGTCACGGGTATTTATGATAATAGAAATTTTTTCCGCCAAAATACCAGAAATACAAAAGGTCATCAATCATT
ATTGACATTGGAACCTTGCCTTTAGGGAAGATTTGGGGGTCATAGTATGTATTCGCTGAAGCTGATTGACATACCCATTTCAGCATAATAGCTAACT
GCGTAAGATAAGGTTTATTACCTTTCTTAGCTAATTTCCATGTATAATCATATAAGTCTATGTTATGTTCAATATTGGGCACGACTTGATTAAAGGA
ACCCTCTTTTGATTCTTTAACAGAGACTGGTCCACGTGGAGGCTCGATACCGTTTGTACTGTTAGAACTTGGGAAGATGACTCACATGGCATAAGT
GCTGATAGTGTGCTATTACGGATGCCAAAGAGCTTAAGGTCTTCCCGCAGCGACGACCAGTCACAAACGTATTTTGGAGCTGCGATTTGGTCAATCT
```

Figure 14(B)

```
TTTTATTGTACCAGTCGATAGGTAATTCGCCTCGAGACCAACGAGTGTCTGAATAATATTCACAAGGTCCTTTTTCTTTGGCGAGCTTAATGGATGC
TTTAATGAGTCCATACTGTAATCTCTCAAATAGTTCATGTGTTAAATCGTTAGCATCTTCATAAGAAGCAAAGTTACTTGCCAACCAAGCTGCATAG
TTAGTAACACCTACGCCGAGGTTACGACGCTTTTTAGCTTTTTCTGCTTCAGGAACTGGATATCCTTGGTAATCCAAAAGATTATCAAGAGCACGAA
CCTGGACTTCTGCCAATTCATTAATTTTATCTTGGTCTTGCCAGTCAAAATTATCCAGTACGAATGCAGAGAGAGTACACAATCCAATTTCAGCATC
AGGACTATTCACATCATTTGTTGGAATAGCAATTTCACAGCACAAGTTACTCTGACGAATAGATGCCTTTTCACGAATAAACGGAGTATAGTTATTC
GTATTATCAATGAACTGCACATAAATCCTTGCTGTTCCTGAACGTTCAGTCATGAGCAATTCAAATAGTTCACGGGCTTTAATACGCTTTTTACGAA
TATTAGGGTCTTTTTCTGCTGCTTCGTATAATTCACGGGAAACGGTCTTGGTCTTTAAAATAAGAATAATACAGCTCTCCACCCATTTCATGCGGACT
GAACAAAGTAATGTAATCGTTCTTTCCGAATCGTTCCATCATCAAATCATTCAGCTGAACACCATAATCCATATGACGAATGCGGTTTTCTTCTACG
CCTTTGTTATTTTTCAAAACGAGAAGATTTTCAACTTCCAAATGCCAAATAGGATAATAAGCAGTAGCAGCGCCGCCACGAATTCCACCCTGTGAGC
ATGATTTAACAGCAGTCTGAAAATGTTTCCAAAAAGGAATAACACCAGTATGGCGTACTTCACCCATGCCAATCTTAGAACCTTCAGCACGAATCAT
ACCAACGTTAATACCAATTCCAGCGCGTTTAGAGATATATTCAACAATTGAAGCGGAAGCCTTATTGATAGACTTCAATGAATCTCCTGCCTCAATA
ACAACGCATGAACTGAACTGTCGAGTCGGAGTACGGCAACCAGCCATAATAGGAGTTGGCAGTGAAATCTGTCGAGTAGATACTGCTTCATAAAAAC
GAATAACATGTTTAATCTATCAACACGGTTCATCTTGATGCAATGCCATTCCAATAGTCATAAATGCAAACTGTGGAGTTTCATAAATTTGACCAGT
GGTTTTATCTTTAACTAGATATTTTTCTTTTAATTGCATCGCCCCGGAATAAGTAAATTCCATATCCCGTTCGTGCTTAATTTTTGATTCTAAAAAT
GTAATTTCTTCTGCTGAATATTTTGACAATAATTCGGGGTCATATTTACCTTCATTTACACAGTAAGAAATATGGTCAATAAATGAACGTGGTTCAT
ATTGCCCGTAAACATGCTTACGAAGAGCAAACATTAAACAGCGTGCAGCTACGTATTGATAATCAGGCTCTTCAACTGAAATAGAATTCGCAGCAGC
CTTAATGACAATAGTCTGAATGTCATCAGTGGTCATTCCATCACGGAGATATGATTTAATATTTTCATATAATTCATAAGGATCTACAGATGTTCCT
TCAGCTGCCCAAGATAAAACTTTAATAATTTTTTGTGGATCAAAGCTCTGAGAAACACCACTACTTTTGATAACATTAATTAATTGCATAAGTCCTC
AACTTGAAAATCGTCTTTAAACAATCGGTTAACTATATGAGCTATTATATCACCATGACACGGCTTTGGTTTACATGTGCATCCTAGCCTCATTCCA
CGTAAAGGCTCTAAATGTGCTTTAGTTATTTCTCCGGATTTAATTCGACGTATAAAATCTTTTTTGAATAATTCAATGGCAGCCTCCCGGCTGCCAG
CATCTTTACCGACGTAATTTCCCCAAAATGTACCACGGTGAATATTAACATCAAAGTCGGATTTGTATTTATTCACTACCCGACATAGACGGCCCGC
GCGGTGATAATTCGGCATATTGTTTTTCCGTTAAAACAGTAATATCGTAGTAACAGTCAGAAGAAGTTTTAACTGTGGAAATTTTATTATCAAATA
CTCACGAGTCATTTTATGAGTATAATATTTTTTGCCATAAATGATAATAGGCTGATTTGGTCCTGGAACTTCTAGCTCACTTGGATTAGGAAGTGTA
AAAAGAACGACACCAGAAGTATCTTTAAATCGTAAAATCATATATCCTCGCAATTAAATTAAAATTATACCGCCATTTTTCCTTTCAAGACACCGTG
GGACTGATAATCTTTGAGAACGAAATCTTTAGGCCTGAGTTTAAGAAGAATATATTCCAATTGTTCTTTAGTAGAAAGATAACGGAATTTATAAGGCAAT
CCGCCTATTACCAGTTCACAAAGCTCTTTAGGTTCACGACGTAAAATTTCTTTACATTGTTCTACGTGATTCATATAGATATGAGTATTACCGCCAG
AAAATATCAAATCTCCAGGAATAAGATTACACATCTTAGCTACAATATGAACTAACGTAGCATATGATGCAATATTAAATGGAAGCATTATGTTCAG
ATAAGGTCGTTAATCTTACCCCGGAATTATATCCAGCTGCATGTCACCATGCAGATCAGACTATATCTCCAACTTGTTAAAGCAAGTTGTCTATCGT
TTCGAGTCACTTGACCCTACTCCCCAAAGGGATAGTCGTTAGGCATTTATGTAGAACCAATTCCATTTATCAGATTTTACACGATAAGTAACTAATC
CAGACGAAATTTTAAAATGTCTAGCTGCATCTGCTGCACAATCAAAAATAACCCCATCACATGAAATCTGTTTTCCATAAATTGGACCAAGTTCACCGCTATGGTATCCTA
AATCTTTTGCTTGATTTTCGTAATTTTCATCCCAAACTGTTTTGCCTTGGATTAACGAATCATGTTGAATTAATCGCAAATCATTGACATTTGTGCT
TCCCGATAAAAACCATATTAGCTCAGCAATGCAAGCTTTCCAGGCGAGCTTCTTAGTTGTTACTGCAGGAAAACCTTTAGTTAAATCCCAGCGTAAT
TTAGTACCGAACAAAGCAATTGTTCCTGTGCCTGTTCGGTCATCGGTTTTGTAGCCATTTTCCAGGATATCTTTAATTAAAAATTGGTATTGTTTCA
TTAGTTCATCCAAGAATATGTAGAAGGATATTTGGCAAAGTTAGGCTTATATCCTAATTTAACCATTTGTTTTGCTTTGCGAGTAAATCCTAAAGAA
CGCTCACCTTTAAGATATTGTTTTGGTGTCATAGGCCCTTGATGCATCTGCCTACAAATAAAAAGGGCCATAGCATTAGGAACATCCTTAACTTTTA
ATTTATTGCTCATTTATATACTGATTCCGTAAGGGTTGTTACTTCATCTATTTTATACCAATGCGTTTCAACCATTTCACGCTTGCTTATATCATCA
AGAAAACTTGCGTCTAATTGAACCGTTGAATTAACACGATGCCTTTTAACGATGCGAGAAACAACTACTTCATCTGCATAAGGTAACGCAGCATATA
ACAGAGCAGGCCCGCCAATTACACTTACTTTAGAATTCTGGTCAAGCATAGTCTCGAATGGTACATTAGGGCTTGACACTTGAATTTCGCCGCCAGA
AATGTAAGTTATATATTGCTCCCAAGTAATATAGAAATGTGCTAAATCGCCGTCTTTAGTTACAGGATAATCACGCTCAAGGTCACACACCACAATA
TGGCTACGACCGGGAAGTAATGTAGATAATGACTGGAACGTTTTAGCCACCCATATCATAATTGTACCTTCGGTACGAGCTTTAAAATTCTGGAGGT
CCTTTTTAATTCGTCCCCATGGTAAACCATCACCTAAACCGAATGCTAATTCATTAAAGCCTTCGACCGTTTTAGTTGGAGAATAAGCGAATACCAA
TTTAATCATTACGCAAAACCCCTTTCAATAAACCATTCAGTGGCTTTATTAGCATCAAAGAATAATTCTTCATACGTCTTTTCTTTGTTTTCAAAAA
CTGTCACACAAACACGTTGACATTCTCCACAGTATTCTTCTGACATGCTCAAAGCGTCAGAAAACATTTCGTTAAATTCACTTAAATCAGGATTATG
CAATGCGTTAAAAATTGCATAATCGAATTCATCATTCATAAATTCAAATACAAAAATCATATTACCTCCCACTGAAAGGGGCCAGAAGCAAATCCGC
TATCTTTAATCATTTTAACTAAAGTTACCATTCCTTTGTTAACTGCTTGTGCGATTTCATCAAAAACTTCATCGCTATCATCATAAAGGTCATTAAA
AAGTTCTAACACGTTCTTCTGAACTTTTAATTTATGACCAACAATCTCGCCTACAGTAAATTCGTTTCCGCCGATTCCAGTGTAAACGTAATTACA
CCAGTTAACAGACTTTCGCGAGAATCTAGGTCATGTGATAAATTAATATAAGCCATCCCGGGTGCAGTTTTAAGTTGGCAACGAATTCTTACTTGGG
TAATTCCGGTTACATGAATGACGGACATATTATTTTCCTCAAATAGACTTTTTCACAATTTTCCAATCAGCTTTAAACTGATCAACGTCAGAATGAT
AAATCCAGAATCCTGCGCTTTCCCATCCTCATAAAGAGGGCATCTATCACATTCATCTTCCCATCCCATATCACGCAAAAGATGTTCAGCTTTTTC
AACAAGCCCAGAATCTTTACCGATGATTAAAATACCATTTACCTTTAACTTCTGATGCTCTGGCGTTGTAATCTCATTTTATTCTCC
TTAGCAAGCTTTAATCAAAAGATATAAACAGACCAACATAACTGCTGCCATAATATAAGGTGCGAACATTTTCTTTTCTCCATTAGTTTTGATAGGG
TAATAGTATTATCACACTACTACCCGTGTTGTAAACTACTTTTTGAAAGTTTTTCGCAAAAGTTCAATGATTTCATCTACATTATTTTCGTCAACAAT
GCAGTGAATTTTTGTTACGCCAGAAACCTTGTCTTTAACTTCATCCTCTTCAGAAGTAGGTTCTTTATATTCGTGGAAACAATGAAATTCGTCTTCA
CAAACGTTAAAGTAAAAATGCTTTCCATTTGCGCATTCAATGTGTTTTATTACTCTAAATCCATCAACAAAGAAAGCTTCTTTAACTTCAAACCATC
CACCATTTTCTTGAATAATTTTAACTATTGATGAATTAGAACGTGGGCGATAATTAATAAATGTATCAATAAGTCTTGGAACAAGCTCATACTTTTT
GCCAATATACATTACGTTTTCCTCATTTTAACGGGGCTTGTAATAGCCCCTTGATAATTATTGTTCAATCAATCCCATGTAAAATTCTGCGTCTTCA
```

Figure 14(C)

```
GAATCCATACCATCACAATATTCATTAGCCATAAAGCGGGTGAGGTCTTCAAGAGGACCTTCAATGACAATAGAAAAATTGCAATAATTGGGATCAT
CGTGAATACTTGTGATACTAAGTTCAGGATAACGATTACGAATAATTTCTTCAATATATTCAAAATCAACGATGTCAATATCAACTTTAGCCATATT
ATTTTCCTCTTTAATTATCAGCAGTATTGCCGATAGTTGTATAGTACCATGGAAGGACAAGGATGTAAACCGTTTTATGAAAAATTTTTGAAATAAA
AAAGGGGACCTCTAGGGTCCCCAATTAATTAGTAATATAATCTATTAAAGGTCATTCAAAAGGTCATCCAGGTCNGTGTCATCAGCACTAGATGAAC
TGCCAGAGCTTGAGCTCATAAAATCATCTTCAGTTTTTGTATTGAAGTCATCAACATTGAATGCATCCAAATCATCAGCAACTTTATCAGCTTTCTT
AGCAGCAGTTGCAGCGGCACCGCCCATCACAGCAGTTCCCATAACTTGACCGAATTTAGTGCTCAGTTCTTCAAATGATTTGAATTTATCTTTAGAA
GTCATTTCAGAAAGGTCAACCATTTGTTCGAACAGTTCTTTCTGGAAAGATTCATCGTCAATGTTTGGAATCGCAGATTGATTCAGGAATTTAGATT
CGTCGTAGTTACTAAATCCAGAAACCTGTTTAACTTTCAGTACAAAGTTAGCACCTTCCCACGGACAAGTTACATCAACCGGAGTTTCACCCATTTC
AACATCAACCGCAATCATCGCGTTGATTTTATCCCAGATTTTCTTACCGAAACGATATTTAAATACTTTACCTTCATTTTCTGGAGCAGCTGGGTCT
TTTACTACAAGAATGTTAGCCCAGTAAGAAGTTTTACGTTTAACAAGACTGTTACTCTTTATTGTCAGTGTTGTACAGATCATTTTTACTGATATACT
GACATACTGGACAAGAATCGTAATCACCGTAGGTAGATGAGCATGTTTCGATATACCATTTACCATTTTTCTTGAAACCGTGATTTACAAGAAGTGC
GAATGGTGCTTGTTCATCATTTTTAGACGGAAGAAAACGAATTACTGCTTGACCGTTACCCGCATTGTCGAGTTTCAGTTTCCACTCGCCTTTATCT
TCAGAAGAAAAACCACCTTTATTTCCAGCCAGTTTAGCCATTTGTGCAGCGAGTTCAGCAGTAGATTTACGTTTAAACATTTTTATTTCCTTTTTAA
TTTAATTAACAGTTGGTGCTATGACGATGTATGACCTCATAGCTGGTCAGTGAGATAATTATAATCTATTTATAATAAGCAATTAATACTTGCAAGA
TTTCACAGTTTCAATGAAAACATTTTTAGCTTTCTGTGAATCAATATTTAAAATTTTTCTATAAGCCTTTAACTTTATAGAATAATTATTCCAGACT
AAATTATCAGTCTGTTCATCATGTTTATCAATTATATTTAAAAACGAATCAAGCAAGATAAACGTCTCAAACGAAATTATGTTCGATTGCAGAAGTT
TAAAAATATAACTTGACTGAACCTTTGGATTATATTCAAAGATTTCTTTAAAAGCAGAAACTTCAACTTTTTTACTAAAATAATAAATGTTGCGAAT
ATCTTCTTCAAACTTAAATTTAATTTGCTTTAAGCGTCCGATATATTCACGATAAAACACAAGTGCATCAGCGTCAGAGATGTCACCAATCCAAGCA
TCTTGGTTAGCAACCAGATTGCTTATAAAGATTAAAGCAAGTTCCTTTAATTTATATTTTTCTGATAACTTCTGGAAAAAATACTTATCCCTTCGCT
TTTGATAAGCGGCATCAGACACCCGCATGCACCAATTATACTTAATTACATCATACTTTCCATTCATATGTTGTTTTATCATTAAGTATAATTTATA
AACTGATTTACCATCAATATATCTTTCACCAACAGCAGGCATGCGGAGTTTAATCATAGTAGAAAATCTAATGTATTAGTTTTTTCACAACGAACAA
CAGAAGGACGTAAAAGATTTTCGTCAATAGCTTCTGACTGAATTTTTTCAATTATACCCGAAGGAATAAATTTAGCAAATTGAGTTTCAGGAATAGA
ATTTTCTTCTAAGAATGCTGTTGTAGCTTCGAGATAACTCATTCCAAACTCTTCTACCATTTTTTCAATAATAAATCCATTTTCTTGGCGGTCAAGA
AGCTTTGCAATTTCATCCTTTTCTTTCTTAATTGAAAGTTCTTTTTCTGAAAGACCGGTCTCATCGACCGGACGAATATCATTTAGAGAAAACTGTG
TCATAAAGTTCAACTACCTCTTCAGTTTCAGCTTCAAACACATCACGGTTACTCTTTATGATACAAAGCTAACAGACGATTAAACATCTTGCCATCAA
CACCAAGTTCATCTTTGGCACGAATTCGAATATCTTTAATCAATTCATTATAACCAGAAATTTTCAGTTTATGATCAGATGCTTCTTTAATAAATTT
AGCCAAGTCTTCGCCATGGATAGCTTCATCAAATTCAACCATTTCTTTTTTAGCCATTATTCACCTCAAAATTCATTAATGCTATTAGTTAATTTAG
AAAGACCCGCTTTTACAAAATATGAATAAATTTTGCCGCGCGGTGGTAATTTATATGAATTATAGTAATTCACAATGTTTGAAGCAATATTATCAGG
AATATAATCAAAATCAATTAGAACTAAATTTTCTTTATAACGATTATATTCAGATTCTGTGAGAAGCACCTTAGCTTGCTCACGGTCATTAGCAATA
GCTTCAACAATAGAGGTTTTCATTGAAGGAGTTCGTTCACCTTCAACCAAAAGTCAGATCGTACTTTAACTGAAGCAACGTTATCCT
TTTTGTCGCCTTTAAGGATTTTAGTCATACAGTCAATTTCAGCAGAACCGCTTTTAATTTTAACCCATTTCTTGTGCATCGGTGACCATTGCTTAAC
ATTTGGGTATTTGTGAAGTTGAGTAAAGTCACCATCCGACGAAATGATTAAAATCTTATGTCCTTCTAAAGAGAACTTTTTAACAAGAACAGCGATA
TGATCATCTGCTTCATACTTATCAATATCCATAACGATGTATGGCATATAAGCTTTCAATTCATCTATAACTTTATGGCTGGATTCAAAATAACCTT
CCCAGTCCCAAGTAGATTCTTCTCGTGCTTTTCCGCGGTTTTTCTTATAATAATAAGCGAAATCACGGCGCCAGTATCCAGATTTCGCGTTATCAAT
ACACAGCACAATTTTAGTGTATCCAAGAGTTTTTGCTTTTTGACATTAAACTTAATTGAGTTCAATATCAAATGACGAACCATTGATAAATTAATT
TTTTCTTTATCTGGGAAGTTTACAAGAGCAGTTGAAAGCGCAATTTGACTAAAGTCAATAAAGCAAATTCCTTCTTTATAATCTTCATCCAGCATCA
TTTCTAAATCCATATGAACCTCGTTCAATTAGTGAGATTTCTATTATATACTATCTAAATCTTAAAGTAAACAGGTATAAATACTTATTATTGAAAA
CACAATAGGAGCCCGGGAGAATGGCCGAGATTAAAAGAAAGTTCAGAGCAGAAGATGGTCTGGACGCAGGTGGTGATAAAATAATCAACGTAGCTTT
AGCTGATCGTACCGTAGGAACTGACGGTGTTAACGTTGATTACTTAATTCAAGAAAACACAGTTCAGCAATATGATCCAACTCGTGGATATTTAAAA
GATTTTGTAATCATTTATAATAATCGTTTTTGGTCAGCAACGGATAATATTCCAAAACCTGCTGGAAATTTTAATAGAATTCGTTGGAAAGCATTAC
GTACTGATGCCGTATATACAACCGTATCATCTGGACCATATCAATTAAAATCCGGAGAAGCAATTTCAGTAGATACATCAGTTGGCAATGACATTGA
GTTTACTTTACCACCTTCTCCGCTTGATGGAGAAACCGTAATAATTCAAGATATCGGTGGAAAACCTGGCATAAATCAGGTTAAAATAAATTCTTCA
AATCAGAGTATTGTCAATTTTAGAGGTGAACAGGTACGTTCAGTTTTAATGACTCATCCAAAGTCACAGATGGTATTCATTTTTAATAACCGTTTGT
GGCAAATGTATATTTCTGATTATAGCAGAGAAGCTGCAATTGTTACTCCATCGACTGCATATCAAGCACAATCTAATGATTTTATCGTACGTAGATT
TACTTCTGCCGCACCGATTAATGTTAAACTTCCAAGATTTGCCAATCATGGAGATATCATTAATTTCGTTGATTTAGATAAATTAAATCCACTTTAT
CATACAATTGTTACGACATATGATGAAACGACGTCAGTGCAAGAAGTTGGAACTCATTCAATTCAAGGCCGTACATCGATTGACGGTTTCTTGATGT
TTGATGATAATGAGAAATTGTGGAGATTGTTTGACGGGGATAGTAAAGCACGTTTACGCATTATAACGACTAATTCAAACATTCGTCCAAATGAAGA
AGTTATGGTATTTGGTGCGAATAATGGAACAACCCAAACAATTGAACTTCAGCTTCCGACTGATATTTCTGTTGGTGATACTGTTAAAATTTCCATG
AATTACATGAGAAAAGGACAAACAGTTAAAATCAAAGCTGCCGGTGAAGATAAAATTGCTTCTTCAGTTCAATTGCTGCAATTCCCAAAACGTTCAG
AATATCCGCTGAAGCTGAATGGGTAACAGTTCAAGAATTAGTTTTTAATGGTGAAACTAATTATGTTCCAGTTTTACAACTTGCTTATATAGAAGA
TTCTGATGGAAAATACTGGGTTGTACAGCAAAACGTTCCAACAGTTGAAAGATGTCGATTCTTTAAATAATTTCTACTAGAGCAAGATTAGGCGTAATT
GCTTTAGCTACACAAGCTCAAGCAAATGCTGATTTAGAAAATTCTCCGCAAAAAGAATTGGCAATTACTCCAGAAACGTTAGCTAATCGTACTGCTA
CTGAAACTCGCAGAGGTATTGCAAGAATAGCAACTACTGCTCAAGTAAATCAGAACACCACATTCTCTTTTGCAGATGACCTTATCATCACTCCTAA
AAAGCTGAATGAAAGAACTGCTACAGAAACTCGTAGAGGTGTAGCTGAAATTGCTACGCAGCAGGAAACTAATACAGGTACTGATGATACTACAATC
ATCACTCCTAAAAAGCTTCAAGCTCGTCAAGGTTCCGAATCATTATCTGGTATTGTAACTTTTGTATCTACCACAGGAGCTACTCCAGCTTCTAGTC
GTGAATTAAATGGTACAAATGTTTATAATAAAAACACTAATAATTTAGTTGTTTCACCTAAAAGCTTTGGATCAGTATAAAGCTACTCCAACGACACA
AGGCGCAGTAATTTTAGCAGTTGAAAGTGAAGTAATTGCTGGACAAAAGCCAAGAAGGATGGGCAAATGCGGTTGTAACGCCAGAAACGTTACATAAA
AAGCATCAACTGATGGAAGAATTGGTTTAATTGAAATTGCTACGCAAAGTGAAGTTAATACAGGAACTGATTATACTCGCGCAGTCACTCCTAAAA
CTTTAAATGACCGTAAAGCAACTGAAAGTTTAAGTGGTATAGCTGAAATTGCTACGCAAGTTGAATTCGACGCAGGCGTCGACGATACTCGTATCTC
TACACCATTAAAAATTAAAACCAGATTTAATAGTACTGATCGTACTTCTGTTGTTGCTCTATCTGGATTAGTTGAATCAGGAACTCTCTGGGACCAT
TATACCCTTAATATTCTTGAAGCAAATAGAGACACAGCGTGTACACTTCGTGTGAGCTACACAAGTTGAAGCTGCTGCAGGAACATTGGATAATGTTC
TAATAACTCCTAAAAAGCTTTTAGGTACTAAATCTACTGAAGCGCAAGAAGGTGTTATTAAAGTTGCAACTCAGTCTGAAACTGTGACTGGAACGTC
AGCAAATACTGCTGTATCTCCAAAAAATTTAAAATGGATTGCGCAGAGTGAACCTACTTGGGCAGCGACTACTGCGATAAGAGGTTTTGTTAAAACT
TCGTCTGGTTCAATTCATTCGTTGGTAATGATCAGCTGGTTCAACACAGCCATTAGAATCATATGAGAAAAATGGTTATGCAGTATCACCATATG
AATTAAATCGCGTATTAGCAAATTATTTGCCATTAAAAGCAAAGCCGTAGATAGTAATTTATTAGATGGTCTAGATTCGCTCCAGTTCATTCGTAG
GGACATTGCACAAACAGTTAATGGTTCACTAACCCTTAACCCAACAAACGAATCTGGGTGCCCCTCTTGTATCATCTAGTACTGCTACATTCGGTGGA
```

Figure 14(D)

```
TCAGTTTCAGCAAATAGTACATTAACTATTTCTAATACTGGAACGGCAACTCGTCTGATTTTTGAGAAAGGACCTCAAACTGGAACAAACCCGGCTC
AAACGATGACAGTCAGAGTGTGGGGAAATCAATTTAGCGGGGAATCAGACACAACACGTTCTACCGTATTTGAAGTTAGTGATGAAACGTCTAGTCA
TTTTTATTCTCAGCGTAATAAAGCTGGAAATATAACATTTAATATCAACGGTACAGTAACACCGATAAATGTTAATGCTTCAGGAACATTGAATGCA
AATGGTGTAGCAACATTTGGTAATTCAGTCACTGCAACTGGTGAAATTATTTCTCGAAGCGCAAATGCTTTCCGTGCTATTAACGGAAATTATGGTT
TCATTGTTCGCAATGATGGATCAGTAACGAATTTTATGCTTACTACATCGGGTGATCAGACTGGTGGATTTAATGGATTACGTCCATTGTCCATTAA
TAATCAATCTGGGCAGGTCACAATTGGTGAAAGCTTGATCATTGCTAAAGGTGCTACTATAAATTCAGGTGGTTTAACTGTTAACTCGAGAATTCGT
TCTCAGGGCACTAAAACATCTGATTTATACACCCGCGCTCCAACATCTGATACTGTAGGATTCTGGTCAATCGATATTAATGATTCAGCCACTTATA
ACCAGTTCCCGGGGTATTTTAAAATGGTTGAAAAAACTAATGAAGTGACTGGACTTCCATACTTAGAACGTGGTGAAGAAGTTAAATCTCCTGGTAC
ATTGACTCAGTTTGGTAACACACTTGATTCACTTTACCAAGATTGGATTACTTATCCAACGACCCCAGAAGCACGTACCACTCGCTGGACACGTACA
TGGCAGAAAACCAAAAACTCTTGGTCAAGTTTTGTTCAGGTATTTGACGGAGGTAACCCTCCTCAACCTTCAGATATAGGAGCGATCCCATCTGATA
ATGGAATAATAGGTAATCTTACTATTCGCGATTTCTTGCGAATTGGTAATGTTCGCATTATTCCTGACCCAGTGAATAAAACTGTTAAATTTGAGTG
GATTGAATAAGAGGTATTATGCGAAAAATTTATGCAGAGTTTGGACAAGGATATGTCCAAACGCCATTTTTATCGGAAAGCAATTCAGTAAGATATA
AAATAAGCATAGCGGGTTCTTGCCCGCTTTCTACTGCGGGACCATATGTTAAATTTCAGGATAATCCCGTTGGAAATCAAACATTTAGCGCAGGTCT
TCATTTAAGAGTTTTTGACCCTTCTACGGGAGCATTAGTTGATAGCAAGTCATATGCTTTTTCTGCTTCAAACAATACAACATCTGCCGCTTTTGTC
AGTTTCATGAATTCTTTGTCAAACAATAGACTTGTTGCTATATTAACTAGCGGAAAGGTTAATTTTCCTCCTGAAGTGGTATCTTGGTTAAGCGGAG
CAGGAACTTCAGTTTTTCCATCAGATTCAGTATTGTCAAGATTTGACGTGTCATATGCTGCTTTTTATACTTCTTCTAAAAGAGCTATTGCATTAGA
GCATGTTAAACTAAGTAATAGAAAAAGCACAGATGATTATCAAACTATTTTAGATGTTGTATTTGATAGTTTAGAAGACGTCGGAGCTACAGGATTT
CCTAAAAGAACATATGAAAGTGTCGAGCAATTTATGTCTGCGGTTGGAGGAACTAATAATGAAATTGCGCGATTGCCAACTTCAGCTGCTATAAGTA
AACTTTCTGACTACAATTTAATTCCTGGTGATGTTCTTTATCTTAAAGCACAACTATATGCTGATGCTGATTTACTTGATCTTGGAACTACAAATAT
ATCTATTCGTTTTTATGATGCATCAAATGGATATATTTCCTCGACCCAAGCTGAGTTTACTGGGCAAGCTGGGTCTTGGGAATTAAAAGAAGATTAT
GTAGTTGTTCCTGAAAATGCAGTAGGATTTACGATATATGCACAAAGAACTGCCCAAGCAGGTCAAGGCGGCATGAGAAATTTAAGCTTTTCTGAAG
TATCAAGAAATGGCGGCATTTCAAAACCTGCCCGAATTTGGCGTCAACGTATTCGCGTTAATTATGTCTGCGAATCGGCTTCACCTCCAGATATAAT
GGTACTTCCTACACAAGCCTCTTCTAAAACTGGCAAAGTGTTTGGGCAAGAATTTAGAGAAGTTTAAACTGAGGGAGCCTTCGGGTTCCCTTTTTCT
TTATAAATAATATTAAAATAAAGGGGCATATAATGGCTGATTTAAAAGTAGGTTCAACTGTAGGTGGATCTGTCATTTGGCATCAAGGAAATTTTCC
ATTGAATTCAGCCGGTGACGATGTACTCTACAAATCATTTAAAATATATTCAGAATATAATAAACCACAGGCAGCTGATAACGATTTCGTTTCTAAA
GCTAATGGTGGTACTTACACCGGTCCAATTACTATTAATTACGGGGTAAATAGTTATCTTCAATTAAGTAATAATGAAACCCCCATTCGAATTCGTT
CTGGTGGCGGTACCGGTAATACTCTTGTAGTTGGCGGCTCTTCCGGCGGTATTAGTTTTAGACCTGCAGGTAGTGAAATCACTACTGGACAAATTAC
TATTACACCAGAAGGTTTGACAACATTTACCAGGGCTGTAACGGCTCCATCGATAACTGTTACATCTACTCCTTCCGCAGCATCTGATGTTACTCGT
AAAGATTATGTTGATGGAGCAATAAATACTGTTACAGCAAATGCAAACTCTAGGGTATTACGCTCTGGAGACACTATGACAGGAAATTTAACTGCGC
CAAACCTTTTTTCACAGAATCCTGCATCTCAACCTTCACACGTTCCACGATTTGACCAAATCGTAATTAAGGATTCTGTTCAAGATTTCGGCTATTA
TTAAGAGGACTTATGGCTACTTTAAAACAAATACAATTTAAAAGAAGCAAAACTGCAGGTCAACGTCCTGCTGCTTCAGTATTAGCCGAAGGTGAAT
TGGCTATTAATTTAAAAGATAAAACAATTTTCACAAAAGATGACTCAGGCAATGTTATAGAATTAGGTTTAAAATATGGAGGAACTATAAATGGATC
TTTAGAGGTTACAGAAAATATAACTGGAACTTTAATTGGAAATTCTAGTACAGCTACTAAATTGCAAACACCTAGGAAAATTAATGGTATATCTTTT
GATGCGATCAAAGGACATTACACTAACTCCATCTGATATAAATGTAAATAGTACAACATTTATAAAAAATAACGGCGAATTACCCGTTGATGCTAATT
TAGATACATACGGGCCCATTGAAGAATATCTTGGTGTTTGGTCGAAATCTACTTCAACAAATGCGCAACCAGCAAATAAATTCCCAGAAGAAAATGC
CGTAGGTGTACTAGAAGTATTTGTGGCCGGCCAATTTGCTGGCACTCAGCTCTGTAAGATCTGGTAACGTCTATATTCGTTCCTTATCTGCT
AAATGGAATGGCGTCGATGGTCCATGGGGTGTGTGGCGTAATGTTCAAGCGTCAACTCGTCCACTTTCACAAACGATTGACCTTGATAGCTTGGGAG
AATTAGAACATTGTGGCTTATGGAGAAACAGTTCAAGAGCAATCGCATCATTTGATCGCCATTATCCAGAAGAAGGATCAGCCGCACAAGGATTTTT
AGAAATATTTGAAGGTGGTTTATACACAAGAACGCAGCGTTATACTACCCGCATGGGTATGGTTTATACTCGTTGTCTCGCTGCTGCATGGGATGCT
AGTGCACCTAAGTGGGAGGAATGGAAGCAGGTTGGTCATGGCACACCAGCGACTTTCTATGATGGAGATCTGAATGATTTTAAAACTCCTGGGTTAT
ATAATATTTTAGGCACTGATGCCGTTATTAACTGTCCTACCGGTGAAGGTTTGCCGACTGTTATTGTTGGTTTGCTGGAAGTTAAACAACGTGCTTC
TGGCCGGTGCTATTTTCCAAAAATTTACTACTGCCGGAACGGGTGCAACTACTCGCGATCGTATTTTTGAGCGTGCATATACTGGTGGTGTGTGGGGT
ACATGGAACGAAGTATATACATCTTACTCTTTGCCAATTACTTTGGGTATGGGTGGTATTAAAGCCCAATTAGCCGGAGCTAGATTGGCAAACATTTG
ATTTTGTTCCTGGTAGTATGTTTAGCGTTCCTTTGAACAAAATAAAGAACATGCCAGCAAATATGAATTGGGGTACAATTGACGGAAACTTAGTTAT
GTTTTCTGTCGGTCCTAGCGAACACACCAGCACAGGACGTACTGTTCAGGTTTGGCGTGGTACTGTATCCAAGACAAACTACCGTTATTTTGTCGTT
CGTGTGTTCGGTAATTCTGGAAATAGAACTTGCACAGTTCGCCGTGTCTTGTTGTTCTTGAAGACGGATCACATACTTGGCTGCTCAACAAGATTTTAATG
GTGCTGTTAACTTTGGTAGTTCAACAACGTTTAAATCAACTACAACATTTAATACAGAAGTTAAATTTCGCTCATTGAATGCATTCCGTATGTATGG
CGGAAAATTTGGTACATTTTTACGTAATGATGGAGAGAGTCTTTATATTCTTTCCACCGACGAAGATGATCAAGATGGAAACTTTAATACAAATAGA
CCTTTCCGTTATGAATTAAGAACTGGTGATGTTACTTTGGGTGGTGCTAGTGGTGCTAACGTTTTAAAATTAAAACGTGATTCTCTCACCGCATTTT
TTGGCGGTGATATTAACATTAAAGGCACGATGACTTTTGACGCCGGACGTTTAGGATCACGAGATTATTTTAAATTTAACCATTGGGGTGATAGTAA
TAATGCGCGTGATAATATCATCCAGTTAGAAGACAGACAAAGGCGCTCATTTTTCCACTGAACGTACTTTAGCGACTGGTGCAATTAAGACTAAATTT
TTTGGTGAAATTGAATCCGATGGTAAATTGGTTATTAAACGTCCGGGTGATTCTATTGTATTATCAACACTGCTAGTAATTCTTTGCATATTCGCG
GTGATATAGACGGGACTGGTAACTGGTATATTGGTAAAGGTGGTGCTGATAATGGATTAGCGTTCTATAGTTATGCTACTAATGCTGGTGTATACAT
TACAAACGGAGGGGATATCGCGCTAAGTCCAAAGGGTGCCGAAATGGCTCAGGTCAATAACGTTCGATTATATGTTCATGGTGAACGTTGGACTGCT
AGTCAACCAGGTGATTGGGGTCGTCAGTGGCAAGTGGAAGCGCCAATATTCGTCGATCATGGTTATGTTGGACCAGATAGCTATTATCCAATTATTA
AAGGAAGAAGTGTAATCACCAATCAACGGTTTGTAATGCCGTCGATCTTGGTATTCAATAACATTTGGGGACAAGCAATTATTCGTGT
TGGATCTGCGGAGGCATCGCCAGCGGCTGGACACCCTAACGCGATATTTGAATTTCATTACGACGGTACTTTCTATTCTCCTGGTAATGGTAACTTT
AACGATGTGTATATTCGTTCCGATGGTCGACTTAAGATCAATAAAGAAGAGTTAGAAAACGGAGCACTTGAAAAAGTATGCCGACTGAAAGTTTATA
CATACGATAAGGTTAAGTCTATTAAAGATCGTAGTGTTATTAAACGTGAAGTTGGTATTATTGCTCAGGATCTTGAAAAAGAATTATCAGAAGCTGT
ATCTAAAGTTGAAGTTGATGGATCTGATGTTCTGACAATTTCTAACTCCGCTGTAAATGCTCTTTTAATTAAGGCTATCCAAGAAATGAGCGAAGAA
ATTAAAGATTAAAAACGCCTTTCTTCACTAAAATTGCTCGCAAAATTAGTAATTATTTTAAATTCTAACAACAAGGGGCTTTGCCCCTTTGGAGAA
AATTATGGCAGTAGTTGGTGTTCCCGGTTGGATTGGAAGTTCATCCGTAAATGAAACAGGACAACGATGGATGAGTCAAGCAGCTGGTCAATTAAGA
TTGGGTGTTCCTTGCTGGATGAGCCAATTCGCCGGACGCTCAAGAGAGATTATTCATACTGTAAGTGCTAATCATAATTTTAATGGTCAGTGGTTCC
GTGATAGATGCTTTGAAGCTGGCGGTGCACCCATTGTATTCAATATTGTTGGTGATATCGTTTCTTATTCTAAAGATGTTCCTTTATTCTTCATGTA
CGGGGATACGCCTAATGAATATGTTGTTCTTAATATTCATGGTGGTGTTCATATGTGGGGTCGTGGTGGTAATGGTGGATACACTCACTCAGGAGGC
GACGGTAACGGTACACAAGGCGGTCATGTTATTCAAAATGATATCGGTGGACGGCTTCGTATTTGGAACTACGGTGTTATAGCTGCTGGCGGTGGCG
```

Figure 14(E)

```
GCGGTGGTGGTATTGCATATCGTCCACACTCAGGGGCAAACTGGCAAGATATCGGTGGCGGTGGTGGTCGACCTTTCGGTGGCGCTGGCGGTGGCGG
TTATTCCGGTGGTGCTGCTTCGTATGAAGGTCCGGGTGGTGGTTATGACTATGGTAACGCACACTCCGGCGCTGGTGGTAATGCTGGTGCTGCTGGT
CAGAATGCATGGTCTGACGGCGGTAAAGTTCTTAAAGTTGGTGTTGGTGGTGCGTCTGGTCATGCAGTGTTTGGATCTTCTCCAACTTGGGGTGTTG
TTGGAACAATTTACGGACCAAGAGTATAATGTGAATAAATACCCTTAAAAGGAGGGTCTATGGCAGCACCTAGAATATCATTTTCGCCCTCTGATAT
TCTGTTTGGTGTTCTAGATCGCTTGTTCAAAGATAACGCTACCGGGAAAGTTCTTGCTTCCCGGGTAGCTGTCGTAATTCTTTTATTTATGATGGCG
ATTGTTTGGTATAGGGGAGATAGTTTCTTTGAGTACTATAAGCAATCAAAGTATGAAACATACAGTGAAATTATTGAAAAGGAAAGAAATGCACGCT
TTGAATCTGTCGCCCTGGAACAACTCCAGATAGTTCATATATCATCTGAGGCAGACTTTAGTGCGGTGTATTCTTTCCGCCCTAAAAACTTAAACTA
TTTTGTTGATATTATAGCATATGAAGGAAAATTACCTTCAACAATAAGTGAAAAATCACTTGGAGGATATCCTGTTGATAAAACTATGGATGAATAT
ACAGTTCATTTAAATGGACGTCATTATTATTCCGACTCAAAATTTGCTTTTTTACCAACTAAAAAGCCTACTCCCGAAATAAACTACATGTACAGTT
GTCCATATTTTAATTTGGATATATCTATGCTGGAACGATAACCATGTATTGGTATAGAAATGATCATATAAGTAATGACCGCCTTGAATCAATATG
TGCTCAGGCGGCCAGAATATTAGGAAGGGCTAAATAATTATTTGTTCGTATACATTTCTAGATATCGATATACACCCTCAAAACCCTCGTTGAATTC
ATCGATGAGGGTTTTCTTATCTTCTTGAGTTAATTCAGAAACAATTTTACGAAATGAATTCTGATTTAACTTTCTACCTTCATGCGTTACTCCAATC
TCATTAAGAAATGCAATAAAATTAGCACGATTCTCAACAATATCTTCTCTGGAAAATTTAATCAAAATAGATGCAACAGTAATAATTTCACGAACTG
TATCAATGTTTTATTCATTAACTATACCACTCAATTAGTTGACTTTGTTATAATATCATCAGACGCTTGATTTGTAAACTGGTCTGTGTTATTTTC
TTCAAAAATTTTTTCTATGAATTCCTTGAACGACTCGCGTTCCTGAGCTACATTATGCTCGATTACCTTTTCAAGATTATGACTCATTCGAAATAAT
CTTCAATTTCGTAATCATGGACATAAATCATTATAGTTTCTAATACATCATCAATACTTTTTCCTGGAGCTGGAATTACGTAAAAATATCCTGCTTT
TGAGAGGTCTTTATAAGTTCCAATCAAGAAATCATTATTCTCAAGATGTAACTCTTCAACTAATTCATTGACAATTGAATGGTATAGGTTTGGTAGA
AACTTATATAGCTTTTCTAGAATATCAATTTTGATTGTGTATTGAACCACGGACTGAGAATCAATAATCATAGACCTTCCCCTTATGTTTCTGTTTG
CGATTAGATTCTTTAAACGCTTTCTTCTTATCCTTATGAACAGAAGCTTTATTAAAATTATGCTTTGCGACTAAATTGTTCATAGTGCTGAATTACC
TCTCTTAAACATTTGCATGTGAATGAAAACTTTTTAGCTACACCACATTCAAATATATGTTCTCTTAAATCGCGTGTATCGGTATATCCCATCTCAA
CAATAAAATGCCGTATTAGATTTTTATCTTTATCGTTGAGAGAATTAAAATAATCGGATTTTGAATTAATTTCCCTGGCCAATTTGAATCACCTTCA
GTTGGCGTTTTAGCTCTTTTATCATCTCTTCGTTCATCGCAATATAAAGATCGCGTAAAGCAAGTTTTAGCATTCCATTTACTGGATAACTAAATGG
ACATACATAATCTTTTCCTACGAGCTTTTTGGTGAATTCCATATCACAGAACTGAAATGCCGGTTCATTTGTATAAATTCCCCAATTAGTTGACATC
ATTTTATTGGCATATTCCAACGCCTGGATTTGATTCTTAATTCCATCAATTTGAAACTTTTTAATATTCATTAGTAAAGGTCCTCAGAGTAAAGTTC
TTTTTCACTACCACCACGTTCAATACGCACTTGTCCAGCGTAAGTTGCAATAATCATTGCTTCTTCCACGTGTCCAGTAATTGCTATACTGGTCAATA
AATCCTTGGTCTTCACCACAAACATGGTCTGATACAAGTTTATCACTTACCTGGTCAAGAACTTCAGCCATATCTTTAGAATAATGACGAGCACCAG
GAATAACCAGAGTCCCACCATCTTTTAACTTAAAGCGGTTGGCTGCACACACAATTCGACGTTGATATTTTTCATTATTGTTCCAATGAGCTACTTG
CCAACAGATTTCAGGAACCTCTTCTAAAACATCCTCTTCCGTATATTCGGTGTAGTCGCCATAGGCCTGTAATTTAGCTGCTAGACTTTCTGGAGTT
TCACGTAATAAAGCCAGGTCTAATAATTCAAGACGCTCTTTGAAGGTTTTCATTTGGTTTCCTCAACACTTTTAATTTTTATAGCTTGTTTAGAACT
TTCAAAGCATTGACAATATACTCTTACCGCATCAAACTGGTTGGCCGCTTAAGATGGACTACACCTTCGCCGTTATAAAATTCTACGACAATTTTA
AATGTTTTCATTTAAACCATCCTTTAATACGTTGCCATAAAGTTTTCTGTTGAGCTTTGTTAACACCAATTGAGCGAATAACTGGTTGAGATTCATG
GAATTCTTTATAATCAGCAAGATAAATTTCGTAAGCTGAATCCATAAAGGAACTTATAGCTGCCATGAAATTATTGCGAATACCTACTGGAGCATCT
TTACTTTCACGAATAATCATGTATTTGCCAGTCTTAATCTTTACAATAGTTCCAAGATAAGCCCCATGGTACCAGATGTCCCACCCCTCCTGAGTGG
GTTCTGCACAACGACGAAGTTCATTGACAATTTCTAACTTGTTCATTATTTATTCCTCACAGTTCAGATGCTACAGTGATTACAGCTTCAATGTTTT
CTGCCGAGCGTTTAATGTCAAGATACACATTACCGTTTTTAGCGATTTTACATGACATTCCGATGTCAGTAAATTTCTGAATATGATGTTCCATCAT
TTTGTATCCAAAAATTCGCATATTTCCATTGTTGTTAATTTCAAAATTACGAATTCCGTGAGTGCGTTTTCTAAAATAGCGAGATAGTTACTACGA
TAAGTTTCAACCTTTTTAAGAACAAATCCATTTTCATCTAAAAGTTTTAACATGAAGTCTTTATCTTCTTCCATATCAGAAGTAATCTCGCGAGCTT
TACGAGTTGCTCGTTTTTTCAGCAGTTCAGGAGCATTTTCCTGTGCATATAAAGTTGCCGCATTTGAAATAATATCCTGAGCTTCACCAGTAATGAT
TAATCCATCACCAGATTTCTCCACCAGGCCTTTTTTAATCAATACCCCAATATTACTATTAACTACTGCGTTACCTAAATCTGGATGCACCTCACGA
ACTTCTGCAGCTGTAATGAAATCTTTCTTAGCAATGGTAATTAAAATCGCAGCAGTTTTTTCATTCAGAACATCGTTAGAAGCTTTGATGATGTAAG
TTACTTTAGACATTTTCTAATCTCCGTAATTCTGTATCAGTAGTTGATAGTTGTATAGTACCACAGTATGCTTTGGTTGTAAACCGTTTTGTGAAAA
AATTTTTGAAATAAAAAAGGGAGAGCCGAGGCTCTCCCTAAAATTACTGCATGACTGTGATAACTGTCATGATAACACGTTGAATTCCGAACGCAAG
AAGACCTCCTGCTACGGCAGGAACAACACCTAAACCCGCCAGTAAAATGCCACCAGATACTAATGCAGCGCTTGTATACCAATGAATGGACTCATT
TGATTTCCTCTAAATCTTTGGTGTATTCTGTAACTACATCAGTAGTTTTCCAATATTCGTTTTCTTCTTTTTTGGCTTTAGTTTCTTCAGCAAGTTT
CTTTGCTTCGTCGGAAGTCATATGAAAAATGTTCATTCCAACTAGTTTATCAACATAAGAAGAATACATATCAATTTTAGAAAGTTCTTCGGTCAGT
TCTTTGCGAGTTTTACCTTGTACAACAATTTCACCTGAAATTACTTTCTTAATGAAATGTGCCTTGGCAAAAGCTAAACGAAATGCTGATTCAGTTT
CTTTGATTTTGTTATCAATTCGTTTTTGGACATAAGTTTTACGAACTTCAACGAAGTCTTTGATTAAATCAACTACATTATCGTAAACTTGCAGCTT
TCCTTTCTCATTAATGACGGTAATATTCTGGGAACGACGCTCAATCAACCCGAAGTCTTTCATAATTTTTGCATGACGTTCTTCTTCATTATCGCTC
AAAGAATATTCTTTGCGGAATTTAACTTTGAATCCAAAACCATGCTCACCGCAAGCATCATCCCATGTAATGAAGCCTTTATCTTCAAGTGGGTCTA
AGATTTTACTCACGTAAGTTTCACGATCATACTTTATATGGAATCTCAGTGATATGCATTTGAGTTCGTGAAGTAAACTTATATGTTCCACGAATTTC
ATATTGCCCATCAATTTCAACGACTTCACCACGAAATTCTGGGAATTCTACCTTCGGTTTAGTTACTTTCTTTCCTTGAAGAGCTTGTAATACAGCT
TTCTTAACAGAAGAAACACTATGAGGAAGAATGTAAGTTGCATAACCAGTTGCAATACCGGAAACGCCATTAAGAAGAACAGTAGGAATAATAGGCA
AATAGAAAGCAGGCGGAATGTGTTCTTTATCTTGATGTACCGGAGCATATTCAGTATCTTTATATACGTTATAGAAATTTTACTTCACGAGCAAA
AATATAACGACTTGCTGCTGCTTTTTGGACGGTACGAGAACCAAAGTTTCCTTGACCATCTAACAGAGGAAAATTATTATTCCAAGTGTTAGCCATC
AAAGCACCTGCGTCTTGCGAGAGTTTTCACCATGATGATATCCAAGGTCCGCTACACCACCTGCAATAGAAGCGGAGTTTGTGAAACTTATCTTTAT
TTCCTCGTGCCAAATCAAGAGCTCGAGCAATAACAAATCGTTGAACTGGCTTAAATCCGTCAATCATATTTGGAATGGCACGATTTTCAACCGTGTA
CATAGCATAAGCCAATGCTTCATTATCAATGATACTTTTTAAATCGCGATTATTCAGTTGCATAAATTTACCATACTAGTGAATGTAGTGCCATAAT
AACATCAGAAATGAAAAGCACGACTTGAATTAATCCGAACATTACTCCATAATATAGTGCTACTAATAAAGCAGCAAGGGCTAATGAATAGCCCAAG
ATTTTCTTAATCATTAGTAGATAACAACACAAATGTTAAATATGCACACATACCCTGGGCTAAAGCTTGTGAAAACACACTGCTAGCATCGATACAG
ATAGTTAAAACACATGCTACTATCCAACAAAATAAATGAAATAACTCCTAATAATTTTGCGATATTCATATTTTCCTCACTGGCGTCCGAAGACGCCT
TTGTTTTTAAGATTGTTACGATAGAACTGCATCACATGTTCGTTATGGAAATTACTCATACACACCACACATTTTGCATAAACGTTCAAAACAGATA
AATCCGCCACCTACACACATCACGACAGCCACATTATCATTAAGAGGTAGACCTAAAGCCGTAAAGATTCCAGTCAATGTGAATAAGGCTAAAACTA
ATAGGTAACCCATTACAAATAGAGCTTTCATTAGTATGCCTGCAAAACAAATTTAAAGTTATCAGCCAACATACGGTTCATTTCTTCAAGTGTTTGA
TACTCAGAATGATGATTACGAGTAAACGCTAAAGCTAACTGACCTTTTCCAAATCCTGTCGTCAAAGGTTTCATCTTAGAAGCAGGAAGATAAAATA
CTGCATATGGAACATTGTTATTTGCAATAGTACGCGCAAGCTGAGACCGACGTTGACGAATATGACTTAGAACTGCGCTGAATCCTTGCTTAGAACG
TTGATTACCTACATAAAATCGTGCAGACACACATGGATTACTAAATGGACGACCATCTAATTTACTTACTAAAAAGTAAAATCCAGGTTTAGATAAA
```

Figure 14(F)

```
ATATCTTTATGCGGAGTTCCCAAAAACCACTCACCACCCTTGATTGTACCAATAACAGTAGCACCTGCATCATTCAGATCAGTAACAGTCATATATT
TCATATTAATTTCCTCTAAATTATTTTCTACTCCAAGGCCGCATGAATACGCGGCCATTAAATTAATCGTCGCAGTCGACGCTCAATTCCCAAAACT
CTTCTACGGTATAAGTTTCAGTATCATTTTCAATACAGAAACGTTCATTACTGTTATTTGCTAAAGTAGCGTTAACTGTCATTTTCTCGCTGGTGCT
CTTAAGAGGTGAAATACGAATTAACTGATCACCACTATCCAAGCAAAAAATTTCACCAACTTTTACATCTTTAAAGATTTTCATAATTCACCTCAAG
GAGTATAAAATCCAAATGCAGTTGTTGACCATCCCATCCAATATGGAAAATTTGCGCCAATGTAAAACATAAGAATATAAAACCAACCACTCAGCAA
ATTCATCATTTTACACCATTCCAAATTGTTTCAACCACGGATTTTAAACCATTTTGATGAATATCCATTCCGACTACCGTCATCAAATAAATTCCAA
CTACAACTGAACCTAAGGCAAAAATCAGCATGAAAATGAATAAAGCCGGAAAAATATTATCGAAAAACCATTCAATAAATGTAAAAGCACTGCGTTT
ACGCTTCATATTTTCCTCACATAAATCCAAAGTAAACGTTTAATACATCAATCATTAAAACGATTGGGAATATACTCAAAACTATTAGTATTATAAC
TACATTCCATATAGCCTTTAACAATCTTTTTCATTTTCTGTTCCTCCGTAGTTGATAGGGTAATAGTACCACGGAAGAACAGTCTTGTAAACAACTTT
TTAAAAATATTCGTAATAAATGTGAATACCAATCACCACTGCTGAAACCTGTGCAACCCACCACGCACAAGCAATAAGTACAGAATTCAAAATTTTC
ATAATAACCTCATCACAAAAGTAAATGTTAAACAAATTAATGGAATACTAATTAACCAAACGAAACACCACCATAATGAACTCATAGTTCAATCTCA
GCAATTTTCATTTCATTACTATTAATAGCCGCTTTAAGACTATCTGAAAGAATTACATTCCAGTGGTCATTCATATGACCATTAACTAAGCGTGTAA
TTTCTTCGGGAGTTGAAAAATAAGGCGTATCAGACTCCCAATGCGATAATCCTAAGCGAGTATAAATCATACCTTCATCATCGCTAGAATATTCAAC
TGACACAAAACTCATCAGTTATTTTATGTTTAGCGTAATAAAATTTAAATTTCATTTTCCGCTCCTCCGTAGTTGATAGTTGTATATTACCACGGTCC
TTGTGGTATGTAAACCGTTTTGTGAAAATTTTAAATGGAAAGATACCATCCGTTGTAGTTGCTTTTTCTTACAACCTTACGAAGGTCTTCTCTGTC
ACCGATGAACTTCGGAGTGTACTGGATGACACCTGGGTGAATTTCTTTAGTGTTGAATATAATTATACAGTCAGCGACCTGATGATTCAGAATGGGC
CCTAGATTTATTCCAGAACCATATGGATACTCTCCGCTGCATCCTGTTGTTACAGAAATCCAACGTGAGTCAGTTTGATGTGTCTTAACTTCTACAC
GAAGCCCGCAGTATCTTGGATGCGCCAATACATCCCATGCGTATGTATACGGGTCATTAACGTCCTCTTGGCCTTTGTTAACATACCCGCTTAGCCA
ATCTGCTACAAAAAACTCTGCGTACACCGCGATACGGCATCTTTCGATAACTTCTGCCTTATCCTGATTTGGGTTTTGTTTTAAAGAGTATCTTGCT
GTATCAGCAATTTTGACCTTCATTTCACTAGTCAAATCACTGTTCGATAGGGTAAATGTCGGAATCTGAAATAGTCTCTGTAAACCCGGATTCGTTT
TCTGCATTTAGACTTTCCTTTTTACCGCTGAGATAAGCGTTATATACTTTAAGAGTGCCGTAATAAATTCGGTCATTTTCATCTAAAGACTCACGGT
CAAGTTCATCGAGTTCCTTTTTATCCATGACTATAACATCATTGCAATAAAGAAACCCAAGTTTTTTGTGTCCAAACTCAAATTTATTACAGTACAC
AATATTAGCGTGATGATTACCATGTAGAGAAAATTTCTTTTATGTCGGAATCACCGATATTCATACAATAAATCATAATTCACCTTAAAACAAAAGGG
CCGAAGCCCTTATTTTATTTGAATTGTGCAATTCTTTTCTCTAAACAGTCAGCATAAGATTTCATTGAGATAAACTGCGAAAGTAACAGTTCTTGCT
CAACTGCACTAACTGTTAGAAACTTTGCGCTTTCTAAAAATTTGCTCAGTGCATTAATTTTGAGCATTAATTGATCGTATTCTTCTTTTACTCGTGC
TTGATAACCTAACATAATTTTCCTTAGTTAAGGGCCGAAGCCCTTATTTAAATTGTTCAGTAACGTCTTCAACTACTTCGTATTGACAGGTACGCAT
TTTAGCATCGTTGTAATCAATCGGAATTGATACTACATCACGCGGATGTACTTTAACTTTTACAACTCGGCTGGTTGAACTGCCAAAGTGACGAATA
TAAGATTTAGAACACACATGCAGACCGCGAGAACAAGTTTGTGTATCATCGTCATTCACACGAGTACGTGGCATTTTAACTACTTTACCAGGACTGT
TATCAAAAGTATTTGAATGACAGTCAAAGTAGTTGTCACGAACTACTTTCCAAGCATAGAAGTAACCATCTTCGGTGATTTCAATATCGTTTGCTAC
CAAGAAATCAAAGAGTCGAGATACCGCTTTCTGGCTTGGGTTTTCCAGCAGATTTTCCAAGAACGGAAAATAAAATTCAAAGTTTTCGCCTTTTTCC
ATCGAATCAAGAATACGATCAACCAAACCAGACCGCAATTCAATATTTTGATAGAATAAGCTTCCACCTTCAATTCGAACATCGCCGGAAATATATT
TTTCAACAGCGCGACGAACATTAATTTTTTGTGCCGCTTCTTCCAGCTTATCCGCTACAAGCAGATTGAGAATTTCCTGGAAGTTTGAATGAGTATT
AGGTGTTGCGTTATAAGTTACACCGTCAACAGTAATTGAAATGAATTTTTTAGATGCATTCCAAATAATGTCAGATTTAGCAACTGGAGCAATAACT
GCATCGCTATTAACTTTAACTGTAATATCACCGCTAATAGTAACTTTAGAGCGTTTAGCTTCTTCAGCATTTTTCAAAACACGACGAATTGTGTCAA
CCGATACACCTTGCCAATCAGCCAATTCCTGTTGGGTGTAATTACCACTTGAATACAATTTAACAATTTCAGCTTGTTCGTTTTTGGTCAGGCATTT
AATATTGTACATAATTTTCCTTATTAGGCCGCAAGGGCCTTCATAGTTTTAGCGATTTGGGAAACTTCATCATCATTTAAAGAGTTGCGATAACCGA
TGAAGTCGGAAACAATACGGAATTTCTTGGTAAACTCAGCAACCATTTTATCACTATTTTTTGAAGCATTACGTGATAATTCATCAAAGAGATTAGT
TACTGTCCAGATATCATGACCGATGGTATCTTTTCCACCATTGAAATACACACCGCGTAATGAACTAACCATATTACCAAGTCGTGTATATTCTTCA
GAAACTTCGTCTGTACTGAAGTACTTCATCATAAAATCTAGTTCAGGATACTTGATTAATTTTATCAATATATCGTTGAGCTGAACTTGAATAACCTA
CATACTTATCATAATCTACATCATCAAAAGCATCTACATATAAATCACGCAGAGTTTCAAAAATACATTGGCACTGACCGAGTTCTTTTACCTTTTT
CTGCAAAAGCGGACGAATAACATAAAATTCATTAATGCCAATAAGATTAGCCATACGAATCAAAATATTCATAGATGGATGACAAAGAGATGTAGTA
CCATCCATAGAGAAAATATCAGAACGATGCATATACGCTACATACCCAGTAATTTCATCTGCTTCTGATGTGAGCGTAAATAATTCCTCTTTTTCCC
AGCGCCCGTCTTTAATTTCAAACTTAAATGCTGTAGCAGCTTTAGGACGAGGAGCTTTACTTTTAACTACCTTTGGAATATAGCTTTTAACTAAAGC
TTCAATTTCTGACAAATAATGAATGTTTAACTTCATCACTTTCAAACATCGCCATAATCAGGAAGCAAATCAATCTGCGATTCTACTTCTGGATTA
ATAAACAGAAGGCGCTCATTGTGATGAATATTCAAAGTGTTATTAAATTCACTATCATCTAACGCATGTGCTAATCCACGGACAATATTAACACGAT
TTTTAATATTATCAATAACGATATTAATTTTTGTTGTATTAATACCAAACAGACGATAACTTGATGCAACGGCTGAAGTTTCATGACTTTGCTTAAT
GCGTTTCAGTCGAGGGTCAAGATTTACTTCATACACCACGCCTGCATTGCATAACTTACTATCAGGTTCAAACATACTCTGCATCTTCTTATATGAC
AGATTTTTAGTCGTGAATTTGACTGAATTACTAATCATATAATCTCGAGCAGAATACCCCATCTTCATTAATTCGCGATATGTATGACGAGGAGATG
TAGATTCTTTAAATCGTTTTACATCTTCATTAAATGCTTTCTCACTGAGTTCTTTAACTCGTTCAATAATATTTTTACGAGTACGATCATCCAGTGA
AAGAGCCTCGCGAGATGGAGCAATATCAAGTGAACCCATTGGAAACTTAATGTAATTCACTTCATTGCGAATGCTTAGCCAGTTACGGTCTCTAATA
ACACCATCGATAGGATAAACAATACCGCCATAGATAGCATATAATCCACCACGATCAGGCCAGTATCTTTCTGGATTTACACCGTAATAGTCATCAA
AATCCGGAAAATAATCAATTTCGCGGTCAAGACCGTTAATGATAGCCAAATCTTTGAATGGTCGCATGATATAAGAAACTTCATAAGCAAAGTTTCT
AAAGTCTTTTTCTTCAACTGGAACTACGATTTCAATACCAGTTTTATCATCTGGACCCATTTCTTTTACGAATGTAGGTTTAATTTGTGGACCATCA
CCATCCATGTAAGCTACATAACCACGAATTTCACCTTTATGATACGAAGTAATTACAGTATCAGTATAACGGAGATTTAGAACCTAAAC
CAAACCCGCCAATAAAGTCATTAGATTCAGCCTTAGATGAACTGAAGTATGAATTATATAACCCAGGAGAATTATCATCACCCTGAATATCAAAATC
ACTCATACCCGGACCAAAATCTCGACAAACAAATCGCGGATCTAATCGTCCTGGAACTTGTATGATAAATTTTTCAGGATTTCCATTAAGTGCATGG
GCATCAATCATATTAGTAATTAATTCACGGACTACTGCACGAATCTTGTTTGTATACAAATCAGATGACAGAATTTTAAATACTTTAGGAGATGCTG
TGATGCTAAATGCTTTGATTTAGAACCATTGCCAAGAATTGTTTCTTTTTCAGTGGTGATAATCATAATTTCCTCATTAATTCATATTACGCTTAA
TAACTTCAGCAACTTCTAGTAATTCATCTTTAGTTGCAGTCGGATTGAATTTTATCTCTAATATCTTTAAAGCGGTTTTAAATTCTTCGGCTTC
TCCCATATCGAAAAGCGTTGAATGATTCTATATTCTCGATGAACTGCTTTATCAAAAGTTCTAAATTTACTTTATATGATTTCATTTCAATATCC
TCATTTGCCCAATTAATTATACCACATCCTTGTGGTAAAGTAAACTACTGGCTCATCCATTCTTTACGAAGGTCAGCATTATCTCCCATGAGCATTT
CAAAAAGCTCTTTCCAGTTCTCAGGAAGTTTAACAACATCATATACTGGATTTTGAATCATCTCACGATATTCAGATTTTTCCAAAGAGCCAAGTCC
TTTAATATAACGGATGCTATGTTTAGGTAGAGCATCTTTAGCACTCTCATATTCAGCGACTGTATAAAACCATTCTTGTTTTTTACCGACCTGAGCG
ATGATTACAGGAGTTTTGACAAAACGAATTCTTCCTTGCTCAAACAGTTCTGGCCAATTACTAAAAAACCCGAGCAGAGAAGGATAAATGCTTCCTA
GACCATCATGGTCAGCATCAGTCATAATAGCAATATTATGATAATTCAAGTTTTCAGCTTTTCACCGAGAACTAATCCAGTGATTGCGCAAATATC
AAACAATTCTTTGTTTTAAGCATATCAGCATATGACATACCCCAACTGTTGAGAACTTTACCGCGCAATGGATAACCACCATGAAGTTCTTTATCA
```

```
AAATCAGTAATCAGAGTTTCACGTCGTTCACCATGTTGAGCTTTCCAAGGCTTCCATACAGCAGATGCATCTTTTTCACCATTGCTCATACCACCAA
GAGAAGTCAATAGTTCGCGGAATTCATCATCAATATAATCTTTCTGATTACGCAGCCAATCAACAACTTCACCCGCAGTAGCCAAATCATCAGGATG
ACGGTTATATTCAGGTTTATCTTTAGCTAAACGAACCTGCAGAGATTTCTGCATATCAAGCATAACTTGCAACGGGTCTTTTTCATCACCGAGAATA
TCCCAGTATTCATTTTGAGCTTTATCAGCGCCTTCAATCAGTTGTGAACATTCATTAAAGTATGCCATTATTTTTCCTTTCAATTCATGGGTTAGTA
GATTAATTATACAATAAATATATAAAGCAATAAGGAGGACATATGGTACAAAAATTAATGGCACTTGTTAATGCCATCAAAGGTAATAAAAAGCGTA
TAGCTTTTACTATTTCTGCTATGGTAGGAATTTTACTCTGGAACTTTATTTTATCACCTGTTGCAATTGCACATGGTATTAATATTCCAGTAGTTAC
TCTTGATACATTCGTAGATTTAGCATTCGCTTTAGTTGGGTTAATTTAAATCTTAGCATATTTAGATAACCGCATTTTAGCCATCAACCCCTGAGCA
ATATTATTTTTCATATATTCCATAATTTGTTCAGTGGTTGCACCTTCCTTTCTAATCATATCATTAACATCTTTTGATTTCAGGGAGATTTATCCC
AAAACATAACCCTTTCTCCTGCATCAACTAATTTAGTCATTCGCTTAATAGTGTCAGGATGACGAGGTTCATTATCTAAAACCCACACACGTCTATC
TTTAAATGGAACAACTTCTAGGTCTAATTGACCACCTGTAATAGCTATACCATTTTCAATAAAAAGCGAATCTATAGGTCCTTCTAGAACATATACA
TCACCATCTTTGACTCGTTCGACTCCATAGATTTTTGTTGCCTCAGGATAAGCTTTGATGGTGATATATTTTTGAGGAGCATCTTTCTTTAATGCAC
GTCCTTGAAAAGACTCAGCTTTTCCGTTAGCATTATAAATTGGAATAACAAGACGAGGCTCAGGTGTTTCCTTTTTATATGTTCCTGGAGCTATACT
ATTAACTAATTTAGGCCATTCAGTTGTAAACAAAGATATTTCCATTTATCCTTTGGAATACAACGAGCTTTTACATATTTATAATTGGATGGTCT
TCCGCCAATTTATCTAATCTGATGCATGACGGAAGAGATTTAATTATTTTCTTCTCAGGTTGTTTAGGAAGTTCTTTAGGTTTTTCTACTGGACGAC
TTTTACCTTTTTCTTTTCTTATTTCAAAGATATACTCACGATATAAATCAGGTTCAAACTCCTTTAAATATATTCCGATTGGTGCATGATAGTTACA
GTTATAACAATGAATATTTCCTTCATTATTATCGCCATAATACCATCCACGGGCTTTATTTTGATCGGTTTTTGAATCTCCACAAACGGGACATCTA
AACCGTAATTTAAAAGTTGAACTATTATTTACTTGTGCGAATTTAGGTAAATGAGCCAATGCACGGTATGCAAACTCATTATCAATCCAAGGTATTG
ATGACATTTTTACTCTTCTTTTTCTTTAGATTCCTCTTTCTTCTTTTTAGGAATCTGTTCAGGACCTTTATTTACTACAGCGCCTGACGTTGTTCCA
GTAGAGATATTTTCAGGATTACCACCTGAATCTCCAGCTACCATATCTTCTTTAATAAATTCTTTATATGTTTTCATATTAACCTCTATTCATAAAA
GCATTAAAAATTTGGTCATCAATAGATGGCACAGTAATATTTTCTGCATCATTTAGCAAATCATTAATTTCATCAGATAGCATAACACATGTGCCTT
TATTTCCTGTAATTGTTACTGCACAATTACGAACGTTTTCTTTATCAAATTTTAGGTTAATATTTTCGTAGTGAAAATCCTTTAATGCCGAATATAT
CTTTAAAATGAAATTGTCTTTTACTACAATAAACCCAACCTCACTATTAAAACGTGGTTCATGGAAACTGTAATAAACCTTTTCATCTATAAAATCG
TATGAAATTTTTTCCATTTTTAAATATGAAAATTCAGAACTATACATATTAACCTTTATTCATAAAAGCATTAAAAATTTGATCGTCAATAGAAACA
TTTACTTTAGACTGTTTTTCTGATGGTAATTCATATCCACATATTACAATTTTGTGATCAATATCAAAATACACAGAAGCAATATGATTAATGATGT
TTTCAGTAAAGTCTAAATCAACATCAATATCTTTTTGACCACAGCCCAAAGGATAAATAATGCGAGTAATTCGATTATCTTTAACAAATATTCCACC
GACATACTCTGTGCTGCGTTTAAAGTTTACACGTTTCCTAAATGAAAAATATTCAGGTTCTTTATGAGCCCGACTCATAGGACACAATGAGTAGCTA
GAATAAGAGATGTCAAATCCTACACCTTCAATATGAGCCAACGCGTCATGATTAAACCAATTATAATCATATGCCAAATCCATTATATTGTAATATG
TGAAAGGCACCGGATTAACATCATGTGTTGTACCTTTAAAATCTGCCCAGGCAACGATTTCGTTATCTTTAACAATTACAAAAATTGTGTCAATAAG
ATATCCACGGTTATTTTCATCAGGCGTTATATTATAACATTGCGCATCAGGAAATTTACCGTATTTAAACGGTGGATTTTTGTGCATATAATAAATC
ATATTATTCACCTGTGATTTCGGTTACGATATTTTTGTTATTAAAGTTTTTATCGCAATACAGAACATAATTATTACTGCATTACACCACCAGACTTA
AGTTGTTTTTGCACTTTAGCTTTCATTTCGGGACGATCGCGCTCAACAATATTCATAATATCCGCTTCAATTTGAGTTTCAACTTCAGTCTGATCTG
CAGTCATAGACCATTCACACAAGTCTTTATCATATCCTGCCATAGCAGGCTGAGCAGCACAAGAAGCCAAAGTAAAAATTGTAGCAAAAATAAATTT
TTTCATGATAATCTCCTCAGTAGTTTATGTTTATATAGTATCTCAATTTCCAACAAAAGTAAACAGCTATTTTAAAACTTCTGCATAATCACATGTT
ACAAACTGTTTCTCTAGCTTAACGATTTTACGAAAATACCTTTTATACTGACGAATCTGCCTCTTCGTAGGACGTACAGCAAACTTAATAAATTCCA
CTCGACCAAATGGAGGACTTTCTTCTGCTGGAATATCTAACACCAATTCCCACGTATCGCAATAAGTGCTTTGAATTGCGTATTTTTCCTGACGTT
ATACGGAGTAGGTTTAAATAAAACAATATGCATATTATCCTCGGTAATCTACTTCACATACTTTCTTGTCATCAATGAAAGCTTTAACTAGTGCTTT
ATTAACTTCAGCATATTGAGTAGTAGCCCATTGAACGTCATCTTTCATCATTGTGGTTTCTTTAGTAAACATGCTTTCATTCTTAAACCACCCCATA
AAAACTACCTTTACCAATTCCATAACAATCTCCTCATTTAACCAACAAGACTACTATACCATAGTCTTGTCAGCTTGTAAACTAAAATTTTAATTCA
TTTGCCAAAGCATCTAACTGAGCTCGAGTCGATTCGTTTCTTTGATAGCGATTCTGCTCAGCTTGTATCTGTTGTGAACCTGCTACCTCACTCACTT
CAGTTGGAGTAGAACTTGTTCAATTTCTACCCATTTCTGATTTCCTTTTTGAACACCCCATCAAAAACTTATTCCATTTATTCTTATCACCATATCG
TGATTTGATTTGCTTAATAAGTTGTTGTTCAGCAGCTGCTAACTCCTCGGTTTCAATGACCGCAAGCATAAAATCAGCTGTTGCTGGAAGACCGGCA
GATTCTGCAATATCGCTCATGTTAACATCAGAAGAATCCCAAGCTTGTTTACCAACCTGTGCTGCAGTCCAAAGAACAGTTTCGGTTTCAACAGCAA
GAGCACGTAATTCCTCTGCAATGGCTTTAACAGTTGTGTAACTATTTTCTGAGTAAACTCTAATGCGGCAAGATTTACAAATACCCAGATAGTCGAC
AATAATGATTGTTGGAACAAAATTCTTCTTGAGCTTTAATTCGTTTAAAAGCGATCGAAATGTATTAGCATCTGCTCCACCAGTAGGATACTGTTTA
ACGATTAAACGACCGAGAGTAGATTTCTCACGCCATTTTTCCATTTTTCCTTTATACTCAGCGTAAGAAATATGCCCATCATCAATGTCATCAAGAG
AAACATCAAGCATATTAGCATCAATACGTTTAGCGCAGACTTCTTCTGCCATTTCCATGGAAATGTAAAGAACATTATGTCCGAGCTGTAAATAATC
TGCTGCCAATGAACACAGACCTAATGACTTACCAACGTTAACGCCAGCCATTAAAACGTTCAGCGTTCCAGTTTCAGCTCCGCCTTTAGTAATTTTG
TTTAGAATTCTGAGTTTAAATGGAACCTTACGAGCTTTATTCATATAAGATAGCCAACGTGCTTCGTAGTCATCCATCCAATCATGACCAACGTAAC
TATCAAATGAAATTGATAATGCTTGGCGCATGATGTCAGGAATAGCACCAACATCCGGCATTTTCTTATTTCGTTTTTCCGGAGGAAGCTCAGCATT
AGTTTGAATTTCAATTATTTTAGATGTGGCGTTAAACATCGCCCTTTGCTGAACATATTTTCTGTTTCTTTTACTAACCAGCTGTGGTCTTCCGGA
GAATCAGCCAGTTTTGAAATAAGTGTTTTTACACCAGAATATTCTGTTTCAGTAAATGAACTATTTCTAATGCAACATTTAACGCATTAATAGATG
GAACGCTATGATACTCGTTGACATGAGATTTAATTAATTTGAATGTATTTTTAGCTGGACCACTTTCAAAATATTCTGAATCCATATATGGCCAAAC
TTTTGAAAAATAAGCTTGATCAAATATAAGATGAGAAAGAATAATTTCTACCACACTTACTCCTTAAAAGAATTTAAACTTTTTCTTTGACCTTTTA
TTAAATGCATCTTGTAGTTGCATTGTAATACATTTTTCTACATGAGGAGCTAACTCAGCTTTCTTTCTTGGTCAAGAACAGCAAAGTCCATTACAA
CCTTTCCATCAACCCAATCCAGTTTAGTTACATACACTATATGTGTAGAACCATCTTCTAGTTTAATGACAATCTCCTGGATAACATTTTCCATAGC
GGATTTAATTATCTTAAGAGATTCATTAAAAAGACGTTCTTTTCTTTCTTCTTCCCCCTCCGAAGAGGGGGATTCATCGATAATTTCTAGATCTAAA
TCTAAATCATCTTTATTCATTAAATTCTTCCATATCACTTAACTGCTCGAGGTCAGTTTCTAAATCAGCAGCTGATTTACTTTTACTTTCTGGAGAT
TTAAATTTTTCAACCTTTGAGTTAATCAATTCATCGACTTCAGCTTCAACAATTTCATTACTATCAATAGCACCTAACTGATAAGCACGTTAATAG
CATCTCGGAATGGTTGATGCTTAAATAAAGGACCCCAGAATGTAGTGCAGTTGGTATCTTTTGCACGCCAAGATTTTTCTTCGCGAATCATCTCACC
GGTTTCTTCGTCAAGAAATTCACGAGCATACCAGCCATTTTTAGGTTTTACCACAAATCCTAATTCAAGAGCCATATCTAACAATCCAGAATAAGGA
TCGATGCCACCGTCAAATTTAACATCAATAAAGAATTTACTTTTTTCTTTAACGGTACGAGATTTTTCTACATTTAGAACAAATTGATACCCCTGAA
GATCAGAACCATCTTTAATCTGGCGCTTACCGATAATGAATACAGTATCAGCCGAATACATTACGCCTGTACCACCTGTCATCACGGTTTTACTAAA
CATTTCAATTGTTTCAATTGTATGGTTAACCGCAACACATGGAATATTTTAATGCTAAAGTAAGGAGTAACAATACGGAATAATGACTTCAGTGAT
TTAGCACGAGTCATATCTGCCACAGATTTTTCATTCAAGGCATCTTCCGTTTCTTTCTTAGAAGCCATATTACCGATTGAGTCGATGAATACAATAA
CCTTTTCACCACGCTCAATAGCTTCAAGCTGGTTCACCATATCAATTTTCAGTTGTTCAACTGACTGAATTGGCGTATGAATTACACGTTCCGGGTC
AACTCCCATGGATCGCAAATAAGCTGGAGTAATACCAAATTCGCTATCATAGAATAGACAAACCGCGTCAGGATATTTGTTCAAATATGCCGCAACC
```

Figure 14(J)

```
ATAGTCAAAGACATATTTGATTTAAAGTGTTTAGAAGGCCCTGCGAAAATAGTTAAACCAGACTGCATACCGCCATCAATTGCACCAGAAATAGCAA
TATTAAGCATTGGGATTTTTGTACGGATTACATCCTTTTCATTAAAGAATTTAGATGTAGTCAGTTCAGCAGTCATTTTAGAAGTGGAAGCTTTAAT
CAAACGGGATTTTAAATCTGCAATAGACATTCATTTTTTCCATAGGCATCATTATATTTTCCTCACTGGTTAAAGATAGAGTAATTATAACACAATA
AATTTAGGCATTAATCAACTGCTATTGGATGAATAGCATTAAACTTATGAAATGCTTCTGATTTTTCTTTGCGCGAAACACACATGCGAAGAACCTT
TAATGGCTCGTCTTCTTCACCCAACGATTTTCGTTTTTCAATATTAGAAGTTTTCCAACGAGCTTGCTCTGGAAACTCTCTATTGATTTGCTCAAGA
GCTCTATTATGTTTTGAATTACTACGAATTGAACTGCACCCGCCCGGAGCCTGTGCTTTTCCAGATACAACCAGATATTTGAACAAGGCCAAATGCG
GATAACCTTGATTAATTAAATTGAGAAATGCATACATATCTTCGCATAAATCAATTTTTCCATACCCAATTTGTTCTGTTGTAAGTTTTCCAAGGTC
ATACCAAGTATTCGTGAATCCATATGAATTTTCACGATAATTACCCCAAGATGAAGTAATTTTAAAAATAGGTAGACGAGCATGGCCATGATAATAA
CCGCAATCCATGGCATCTTTAACGTATTGAATCAATTCATAGAACTGTTCACGAGTTAATTGATTAATTTTATCTACACAGCGACGATCATCTTTCT
TTCGCATTGAACTCATACGAATAGTAGTATCATCATCAATCATCCAAATTCGTTGACCTGCATACATATCAGTAATTGCTTTACGAGTACCAGCAAT
TCCGTTAACATCATCAGGAATAGTTATAATTTTAGCTCTAGACCCGTAAGCGTCATAATAAGCTTTTTCTTCGTGTTCACGTACTACAATATGCGGT
TCATAATCAGATGGAAACATATCAAGGGCAGAAACTGCCCCTACGCGTTGATAGCTTGGAATTACGAATTGAATCATTTCCACTCACCGTTATAATC
TTTTTTTCGCAATATGTGTTTCACCAGTTTTCCACCAATGGTCAACCAAATAAAAATGACGGGAATACACATGAAGGCTCCCGACATTCCATATAATG
GAACCTGCTTTATACTGACGAGTTGAATCACCTGCATTCAAATCAGATACTAATTTATCTAATACGTATTTTTGCCATGCATAATCATTACGGAATC
CGAAGACCACGTCATTTGAACGCATGCTTACTACTGCATTGACTTTCTTATCACGAATCAGGTACTGTACTGTATTCGTACACATGAAATCTGACAT
ACCATCTTTATTGTAGTCAAATTGCATGGATGGACGAGTATAAATCATGATACCACGTCGAGAATCAGGATTTTGACCAAGTTCAGCTAAACACATA
TCATACTGGGCATAGTTATCTTCTGACCAGATAGCCCAACCATAATTCGAGTTAATTTCGCCTTTAGAAGATGCTACCTGCTGCCAAATCTTTGGTG
TTTCACCTGGAATATCTTTAACAAACAAGCTCTTAGATTTATACCATTCAAGTTCACGCTGAATGTATTCATCATTAAGAGCGCCAAAAATAAACGG
TTCATCTGCTACAAATGATGCGCCAATAATTTCAATAGTTTTAACACCAGTTTTATCAACTACGAAATCTTTTTCTTTTAATGCAAGCCCCAAATGA
AGACGGATTTCTTCAACTGTCATAGAGTCACTAATCATCATTTAAACCTCAATTGATCATTTCATATTTAACTTGTAACAGTAATAAACCCCAACCTAAA
ATAATAGTTGGAATCATAAGAGGGAACCGTTACACTATAGTATATACTTATTATAATCATCAAGATTAAAAGCAACACTGCTATAATTTTGCTTTTCA
TTCCTTCTCTCTGATGATAATTACCTGATTTGGTTGTGCAGACTTTTTAGTTTCACCCGCAATTGACCAAATAAATGTAATAAACCAACCAATAATT
GACCAGTTAAACAGTAAAGACGTGAAAAAGATTCCTACTGTTGATTTTGACCCACGCATCAAGGCGATGAACCATGGAAGCATGTATATAATAATAG
CCAACACACCTGAAACTAAAACCATAAAAATTGAACCTGCTACTAAAGTTTCCATGTTTTCCTCACTTAGTCAAATTTTTTACACATGAATTATAAG
AATTCACTACATACTCCATCGGAGCATTTACCAGTACGCCATTGGTAATTATTAGCCCAATTAGCCCAAATTTCGGCGCAGTAGTTTTCAATTTT
TTCTTCGCGTGTAATTACATCAGAATTACGATATGCTTGAGCAGATTCATCTGGACGAATAGCTTCGTCAAAATTTGCCTGCATTTGTTCTACTGTT
TGCTTTGGAGCTTCTTTATAACACTTGACATTAGGATTATAAAACTTGCTTGAACAGTTTACAATTTTTCCTACATCAGACTGATTTACTACCGGTC
CTTGAGCTACACAACCAGTAAGACCTAATGCAATAACCAAAATAGCGATTTTCATAATAATTTCCTCAAATGCAAGTAGTAATTACTCCAGTAGTGC
TTATGCAGGTATTACCCATTTGCACACCTAAAGATCCATTTGTATTCACATGAAGATTATCATCAATTTTAACTGATATTTTACCATTAGTGTGAAT
AACGGTGCTAGATTTAATCACAGGTTGAGTATCATTTTCAACACTGACAACTGCTACTAATGCAACTAAACAAACTGCTAAGCATCCCATA
ACAATTTTCATTTTATTCTCCAAATCTGTATCAGTAGTTGATAGTTGTATAGTACCACAGAGGAACAGTCTTGTAAACAGTTTTGTGAAAATTTTTT
AGGGAATTCTAAAGGTCCAAATCATCTGTTTTTCATAAGTATAGATTTATATTACTTGTATGAAAAAGGGACCCGGAGGTCCCTAGATTATTCTA
TCAGCCAAACAGGAAGTCTAACGAAGCTTTTTCTTCATAGTCCATACCAGCCGATTCACACATGCCCGCAAGCGGTTTAACAAACGATTTTTGGAAC
AAAGTTGAGTAGTCAATCCAAGACAGTACGTCAGAACGAATTTCTTTTGGAAGTTCTGTACCCGACGGCCAAGCAATGCATTTGTCACCAAATGGAT
TTCCTTCACGCAATGGAAGAACCATTACTTTATTTCCATCCAAAATTGGAGCTACACCTAAACCGCTAACAGCTCGACGATAAGTTAGCACACCACG
AATATGGAACGGGCATTTAAATCCTGGCCAACCTTTATCATCATATTTCGCTATATCGTTCGCAGTTTTTACTTCAGCAATAACTTTATAGTCAAGT
TGACGATATTCTTTCTCGAAGTTCTTGTAATATTCTTGGACAGACTCTTCACCTTCTTGAAGAATACGACGAATACTTTCTTCGAGAGCTTCTTGTA
CTGCTTTTGGTGTTGAACTCTGCTGAGTTTCCATACCCATGATTTTTAGATGTGGTTCAGCAAATCGCTTATCTTCCATATCATAAACGTTCAGAGC
ATAACGTTTTTTCGCTTTCCAAAATCCACCAACACCCTTTGAACCAAGCGGAGGACAAGAAATAGCTTCACGGTCCATATGCATCAGATGCTCGCGA
TTATTCATATAATCACATAACCTCACGATATGCAACATCAATCATACGGTTCCATCCTTTTTCTTACCGAACTGATTCATGAATTCAACTAAATCATTTT
GTTCTTTAAAGCGGTCAAGACCTACTTTTTCAATAACTTTATCTACACAAACATATACCGAATCAGTATCACCTGCTGCGATGAAATCTTCACCATT
AGTTCCACATACTTTATTNAGATATTCATTAATTTTACGAGCAATCCACTGAATACCAACTTGCCGAAAATTGTGATAGCAGTAGCATTTCGCAAA
TCATAGTAACGAAAATGAATATTACCAAGAGCACCGTAAAGACTGTTAATAAGAATTTTACGGTTCAGCTGATTTGTGTTAGCAAGTGTAGCTGCTT
TTTCACATTCTTCAATCAAACTATTGAGAACAGATTCGGTGTAATTCGATAGTTCATTTAAGAAATCATCACTGAACTTAACATATCGTTCAACTTC
AGGTTTAGTTGAACAAGACCCTGCGCCTTTCATAATAATCTTTTTAATAGCTTCGGCATTCATTTCTTCAGCGAACATTTTCTTTTTCCAATCTTTA
CGCTGGAAAAATACTTTAGCGATTTCCTTTGGAATGATACCTTCTTGATGCTTATCATACATCCATCCATTCGGAGAACAAGAATATTCATCACTCG
GTTTAGGAGCTGTTCCTGCAATATATTCATGAATTGGATGAACTTTAAACTGCCCACGAATAGTCTCAGGACTAATGTTAACCTGACGAATAATGCT
CGGATACAGAGACGTCAAGTCAAAACTCATAATATATCGACGAGCAATTGGTTTAGGTTCAAACACAAATGCACCCGGAAAACTCTGTTTAACGTGC
GAACCCTGTTGAGGAATAACCTTATGTTCACCTTTCAATGAGTTAAAAATAATGGCATCCCAGGTTTTAATAGGACTCATTACACCAGAAAAGGCA
TTTTAGCGTAATAAGACATCGTGCGGTTTAAAACTAGATCGATAAACCGCGAATTTTATCAATTGCTTGAACTGATTCTACGTCAATGATGTTATAACTAAT
GTATCGTTGATGATTAGTCTCACGAAGTTTATTAATAGGACCGTCGTATGGTAATTTACCTTTTTGGTTTCATGCTGAGCAACTGATTCCAAAGAG
AATGACGGCAAATTAGTAAATGCGAATTTCTTATACAAATCTAAATAATCAAGAATAGATACGCCATCAATAGAATAAATTTCTTTGCTACCGTACA
TATTTTGGATAAGTTTAGATTTTACTCGACCGATTGGAGAGAAGCGTTTCATACTACGTTCACCGAGAACCATTTTAACGCGATTCATGATATACGG
AACGTCAAATCCCTCAATATTCCAACCAGTAAAAATAGCAGGTCGTTTCTGTTCCCAAAGATTAATATATTCCATGAGCATATCACGCTCATTATCA
AATGGCATATAAATTACTCGGTCAAGAATTTCTTGAGGAACTTCATCACCACCTTCACGCTCAAGCTTAGCAGCTAACTTTGCATCCCATTTTGATA
CTGAACCATACATTGAATTCAAAAGGTCGAAAACATAAAAACGATCGTCAATTGAATCATAATGAGTGATAGCATCAATTTCATATTCTGCTTTCAT
TGGGTCAGGAAATTTATCACCAGTAACCTCAATGTCACAGTTAGCTACACGAACAAATTTTCGGTCATAAACAATTTCTGAACCATATGTATCACTG
ATATAAGCGAGTTTAAAATCGTTCATACCGAGAGCTTCGAGACCGATGTCTTCCATTCTCTTCATCCAATCTCGAGCATCTTTCATTGATGGAAATT
TTTGAGGAGCGCAGTTTTTACCATAGATGTCTTTGTACTTTGACTCTTCCTTACAATGCCTAAACATAGTTGGAAGATATTCTACTTCACGAGTACG
TTCCTTTCCGTTTTCATCAATATAACGTTTATTTCCGACTGTTTCGATAGAGATATAAAATTCTTTCATAGATATTTCTTAGTTTATA
GCCCGAGTTATTAGGCTCTTGATATATTATACTCCAAATAAGGGGCCGAAGCCCCTTGCTTAATTACCAATCGTATATTTAGGAACGAGTTTCCATT
CATGTTTTGTTTAAAAGAAATAACTCGGAAGTTATTAGTTAAATCTTTCATAAAAGTTCTTTGACCAGGGACGATTTCAATCAGTCCCCAATCTTC
TAACAGCCATGCAATCGAATCACGACGAACTTCATCTTCTTCGTCATTTCAACTTGACGGCCATCCATACGAAGCATTTCTTTAAAATGAACGATA
TAGTATAGTCCTTTTTCTGAAGAATATGACAGGACTGATACAGAACTTTATCTTTATTATTAGCAATTCCCATACGAGTCAAAGTTTCTTTTACTT
TCAGAAAATCTTCAGGTTTTTTAAGAGTAATTTCAATCATTTTACCATTCCAATGCTAGTTTTTGAGTTGTTTCTGTTCTTTTACGTTCTTAGTCA
CTTCCTTTCAAAAAATCATCCGTGACTAATCCTTTAAGTTCTTTTAATACTAAAGGTAGTTTTCCATTTTTAGTAAGAATTGATTATAGTTAATTGC
```

Figure 14(K)

```
ATCATTTGTATTAACTTGATACCGCTTAGCAAGTAACTTAATAATCAATACTTCGGTGGAATCTTCAACTAGTTTTGCCCATTTACCATATCTTTTA
CCCCGAGGAACTGCAGCCATTAGATAATTAAAATGAGCTTCATCACTTAATCCAGAACCGATTAAATTCATAGCATATACAGCTGGCATGCACTCTG
GAAATTTTGATAATGCATTTTCAACCATGAATTTTGAATAATCTTTTTGAGCAATAGAGCATTTAGTTTTATTATTAATAGCTCCAATTATTTCAAA
AAACTCATTTTCAGCTTTTTCTTTAAAAGAATCAGCAGCGGATTGGACAGCTGTCCAATCTTTTGAATACCAAGCAACTTGATGCTCGTTTAATTGA
ATATCATCTTCAAATAAGCTCATATCACTTCCACTGCATTTCACATGCTAACTGAATGAAAAGATAAGCTAAATGCAATTCAGTATTAGCTGCAATA
CCATGGACTGATTATTTTCGCCGACAATTTCGTACATACGAATAATACTCTGTGGAGTTACACGTGAATAGATTCTTCGGCAAGTTTACCAACAA
ACCAAGAATAATCGGCTGCATATTTTGGTGCTAAAGCTCTGAGTTGTTTAACATCTTTATTTTTGAGAGACTCAAGAACATCATCAATAGCACCACG
ATCGTTAGTAACCAGTGATAAAATACCAGCATCCAAAACACCTTTAGATGAATAACTATCGAGCTCGCCAATAGTTTTACGAAAATCAGGAAAATTC
TTTTTAACCAAAGCTGCTACAACTTTCATATCAGCTATAGCAATTCCTTCATGCTTGCAGATTTCAGTTAATCAGCGAATCATCTGCTTCATCATTT
CAATTTTATCTTCATCAGTTGGTTGACCGAATGTAATAACTCGACAGCGTGACTGAAGCGGTTTAATAATACCATCAATATTGTTAGCAGTAATAAT
AATACTACAGTTTGAGCTATAAGCTTCCATAAAGGAACGAAGATGTCGCTGAGACTCTGCTAACCCTGAGCGGTCAAATTCATCAATAACGATTACT
TTTTGACGACCATCAAATGAAGCGGCGCTGGCAAAATTAGTCAAAGGACCACGAACGAAATCAATTTTACAATCTGATCCATTCACAAACATCATAT
CAGCATTTACATCATGACACAATGCTTTTGCTACAGTTGTTTTACCTGTTCCTGGAGAAGGAGAATGAAGAATAATATGTGGAATCTTACCTTTACT
TGTAATAGATTTAAAGGTTTTTTTATCAAAGGCGGGAAGAATACATTCATCGATAGTAGATGGACGATATTTCTGTTCAAGAATGTGTTCTTTTTCA
TTTACGGTAATCATAATTTCCTCATTCAAGTTTTAGTGTAAATTTAAGGGCCGAAGCCCTTTATTAAAAATCGTGGGTAGAATCAGCTTCAAGAGCT
ACCACATAATTCGCGTGTTCACCTTCAAATTTAGCAGCACCTTGTTTACCTTTTGCCCAGACGAGAAGTTTATAATTTCCTGGTTGCATTTTCATAT
TTGCCATATTGATAATGAAATTAAATGTATTTTCACCATCATAATCACCAAGAGTCAAAGAATATTTAACACGGGTCAAAGCAGAATCTTCTACTTT
ATTAAAACCGTTAATTACGATTTTACCTTCTTTTACCGTGATAGCAATTGTATCAATTTGCAGACCACGAGATACACGCAACAGTTGTTGAAGGTCT
TCAGCTTTAATTTCAGTAACAACAGATGCTACCGGGAATGGAATTGGTTTATTAGGAGCAACTACTGTACTCGGATCGGCTGCTGGCCAAAAAATTG
TTGAGCGTGCATCAGCAATTTTAATATTTCCATCTTCTGACTGGGAAATTTCTGCATCATCATTAACTAGAGACAGAATACCGAGAAAACCGTTCAA
ATCGTAAATTGCTACATCAAAATCAATAACGTCAGAAATATTTGCTTCCGCATAAGTTGTACCATTAACTGCACGAGTCATAATAAATTGACCGGAT
TTAAGCATAATACCGGAGTTAATAGTAGCGAAATTTTTCAGCAGAGCAGTAGTATCTTTAGACAGTTTCATGTAATTTCCTTCAATTCAAATGAGAT
TTAATTTTATAACTAATTTAATAAAGCAATTAACGATTAAAATCAGCCGCAATTGTTTCAGCAACAATTTGAGCAGCAACAATTAGGCGTTCATCTG
CATTACCGCAATATTCATCTTCAAGGCGTTCACCACATGAAGTCATAATAAATTTAGCACCGGCGTTTAGGGATTCTGCAGTATGTTTGCGCATTAG
TTCAATCCATTTATTACTTCACGATCGATAGCTTCATAATACGCATGACGAGCAGGTGCAGATTTAATTTTGTTCTGAATAACTTCCATTGCG
TTATCAGAAAGAGACAAAACCCATGCGCGACGAATTTTATTTTGGTTTTGTGGATTTGATTCAGAACGCACGTGTTTTGGCTGAATATCTTTTACAT
CAACAGTATAATTCACGGTAATTTTAGTCATAATACACCTTTAGTCATAATAATCAGTAACAGTCCAAGCTTCATTTCTGTTGGACATTATTTTCGT
ATATTCTGATTTAAATGCATTCTTAAGCATAGATTCAGTAACTATATGCTCTTCATTAGAAAAATTATTTCTCAGAATATATCGTTTTATTTCAGGA
ATAGTTAATAGATGCTGTCCAGTTGAATATTCTGCCACAGTTCCTCCGTATAAATATGTTTATCACTCGCTGTATCAAAAGGATATGTTATGAATTA
TAAACTAATTTATGAAAAGTTAATCTCTAATGCTAAATCTCGAAAACTTGATTGCTATACTGAATTCTCATCACATTATACCGCGCGTGTTTAAATGGA
AGTGATGATGCTTCAAACTTAGTAGATTTAACACCGAAGAGCACTATGTAGCTCATCAACTTTTAGTAAAAATTTATCCTTCTGAACCAAAATTAG
TCTATGCTGCTAACATGATGACAGTTTCTACGAAATACGCTAAACGCAACAATAAAACTTTCGGTTGGATTCGTCGTAAACTCTGGGAAATAGAAAA
GAACAAAGAATTCTCCCAGGAGACACGAAAGAAAATGTCTGATGCAGTAGCTAATAAAGCAAGACTAACTTGTCCTCATTGCGGTAAGTCTGGATTA
AGCGGGAATATGAATCGTTGGCATTTTGATAACTGCCCAAATCACCCTAATCCTAAAGTTAGACCACCAATGTCTAAAGAACACAGAAATAATATCT
CAAACGGGCTTAAAGCAATCGTTCTTGAAGAAACATCCTGCGAATTCTGCGGAATGATAGGCAACAGAATGCGTTATCGCAGCGCATAGAAATTTCTG
CAAGAAAAATCCAAATGGACGCAAGAAAACTGAAAAGACTGGTACTTGCGTCCATTGCGGTAAAGTTACCACTTTCGGAAATTTATCAAGGTGGCAT
AATGATAACTGTAAATATAAACCTAGCTAATCTTAGCTAAACTAAATCTACCAACTTTTTCCATCTGAATATGCTGACCATATTCTTGTGGGTCATG
GTCTTTATGCGAAATTATGAAGAAGTTGGTATCCTTCAAACCATCTAAAATTTTAGCTACATTTTTAATGCCTTCAGCATCAAATGCACCATCATAC
ACTTCATCAAGAAATAAACAACTTATTTTAACACCTGAAACTTTTTCAGCAATATCACGCCAAGTAAATAAAAGAGCAATATCAATTCGTGCTTTTT
CACCTTGACTAAATGAAGCATAACTAAAATCTTCACGACCACGGGATTTAAATTGTCTCATTAAATTCTTCATCTAATGTAAACACATAATCCGCTTC
CATTATTTTAAGATAATGGTTAATCTGCTTATTAAATAATGGAATGTACTTTTTAATAATAGCACCTTTAATACCAGAATCTTTGAGCATATCAGTC
AAAATTCCTCGGTGGTATTTTTCCATTACTAAATTAGTTTTTGTCTTAACAATTTTATCAAGTTCTTCTTGAAGCAATGCTATTTCATCAGCATGGT
CAATAAACTCAGAAGATGCTTTTTCTATAGCTGCTTTAACTTTTTTAGCTTTATCTACTGTCGTGATTAGAGATTGCTTTTTATTGCAATATCATT
TGCCAACGACTGCTGGGTTTTAATATTATCTCGGTATTCATCAACAAGAACTTTTAAATTATCACGATGTGTTGAAAGCTGTTCAAACGAATGCGTA
CATTCAGAACTTTATCTTTAATTTTAGAAACAACTTTATCACCGGAACTTAATTGTGACAAACAGGTTGGACATAATCCGCCTTCGTGATACATAT
TAATGACTTTATTATACGAGTCAATTTTTGATTTAATTAAAACTGCTTCTTGACCGATTTTATTAAATGCATCAGTCGGGTCTTCATCTAAAACAAT
ATTAACTAATCTTTCATTAGCTTCTTCTATTTCCGATTTTAGCGTTCTAGCTTCTTTTGCCAAATCATCATACATATTTTGAAGACGAGTAAGGTTG
TCACCCGTTAATTTTTTCTGGCGTTCAACGTTATCATTATATATTTTAATTTGTTGGATAATACTATCTTTTTTAACATCAAGCACTTGGTTCTGCG
AATTTAATTCACGTATTAGTGCTTTATTAAGCTTATCCATTTCAGCTAATGTTCCTACCTCAAGCAGGTCTTCCACAAGCTTTCTTCGTGCAGGGGT
CGACAAACCCATGAAAGGGGTATACCCTGCTGTACCAAGGACAACAATCTGCTTGAAACTGGCATATGACATTCCGATAAGCTGTTCAAATTCTGCT
TGGAAATCTTTACTGCTGGCAGATTCATTAAGACGTGTACCATTAATGGTGATTTCGAAAACGTTTGGTTTTTGTCCTCTTTTGATATAGTACTTTT
TCTCATCATATTCCATCCACAGTTCAACTAAAAGTTCTTTCTTATTTGTGCTGTTTATTAATTGACCTTTCTTTACATCACGAAATGGCTTGCCAAA
AAGCCCGAATGTGATGGCTTCAACATAGTAGACTTACCACCGCCATTTCGTCCAGTAATAAGAGTTTTTGAACCTTATCTAATTGAATGTCAATA
GGATTTCCACCTACTGACATTATATTTTGGATATCTAACTCGGTTTAGTTTAAAATTCTTCACAAAAGATTCCTTTTAATGTATCTTTTAGACCATTC
TATCATATCATCATAATCTAAAAGTATTCATCAAATTCAGCCATGCAAACAACGCCTTGTGCTGTTTTTGATGTAATATAAATTATTCCAACATAT
CTAGAATCTTCTTCGGTATAATCAATATTTGCTATGAATTCATCATTAATGCTCAAATGTCGAAAACTTCACAGTATGCATCCTTAATACAAGATACA
GCCATATCTCGTAATGATTTAGGTGTGTCATTATCTAAAATGTTGAAGTTAAAAGATACAGCCCAATCAGTGCAGACCGTGACCTTTTAATACAAT
TATCTTCAACCTCTAGCGGTTCAAACCAATATTCAATAATTTCTTTATGCCCAATATCATCTTTTACTTCACATTCAAAATGCTGACTCATCATAAC
ATTTTTTAAATTCATCAAAAGTCATTGTGTTGCCTCTACATATAGCTGATTCGCATATTGAATAAGTGCTTCACGGTCAGAATCAGTGATGTCTGGAA
TTGCATTAATGTATTCTTCCATCAACGTCTGAAGAGATTGAACTTCAACTTCTTCCATCATCTGACAGAGTTATCAATCTTTGACACAAC
TCGTAATGAATGCACAACTTTCTCTAGTTCAGATTCGAACTTCGTCAGATTTTTGTCTACTTCAGTTACTATAACACGTACTGATAGATTTGTAAAA
TCTTTATAGTCAATTTTTCCTTTAAATGGATAATGAATTCTACGATGCCAGGTAGTATTGTTTGGAATAAATTCCATTCGTTCTGTTTCTGTATCAA
ACATCCAGAACCCACGAGGGTCATTCTCGTCACCGGCAGTTAGTGTCCATGGTGTCCCAATATATCTGACATTAGCAGCCTCAGAAATAGTATGGAA
GTGACCAGACCACACTTCTTTATAAGTCTTAAGGAAATCAGGTTCAAGACCGTGAGATTTCATTCCTTTATAAAAATAAAATCCATTCAGTTCCCAG
TGACCAACACAAAAAGAAGCAGAAGAAGTTTTTATGTGCTCGAGAATTTCACCAGTATTTTCTTCACACATCCAAGGAATCAAATCAATCAAACACC
CGTCAAAATCTACTGTAGTAGGCTTATCATATACTTTTAACATTAGGATATTTAGCCAAAAGCTCAGTAGAGGCATTTGGATGCATTACATTTTTGTA
```

Figure 14(L)

```
GTGGAGATCGTGATTTCCTACAATAGTATGTAGGGTAATACCAGCATCATCAAGCATTTGAACTATTTCACGAGCAAACTCCATAGTTTTATGCGTG
ATCGCTTTTCGCACATCAAAAATATCACCGTATTGAATCCATACCGTAATTCCATTTTTCTTAGAATATTCTATCGCTTGCTTAATTCCATCAATTT
GAATACCGCGAATCCACTCATCATCAGCTTTAACGCCTAAATGCCAATCACCTAAATTTAAAATTTTCATATATCAAGAACCGTCATTGAAATGCAA
AATAAAATTATTGAAATAAACCCATCTGGTGTGCTAAAGAAACCAATCCAGCATGCTCTAGTGAATAGATAAAATGCAAGAAAAAGTATCACATATC
CAAGAAATATCATTATATCAAACTCCGTATAAAGCTAAAGGGCCGAAGCCCTTTATTTTGTAATAATGTCAAACTGTTCTTTAAAGCAGAAGCTTGA
ATCTTGATGCTGATACAAAAATTCATAAGCTTTTTCGCGTTCGCGGTCATAAAGAGCTCGGTCAGATGACAGTTCTTTAATACGTTCAAACGTTGAT
TCCATATCATTTTCATCAAACCAAATGATACCGCTATCATGCGAGGTCAAAGGAGTATTATCAACACGGAATTTTAAATTTTCGCCAGTAGATTTCC
AAAATACCGGAATTGTTCCACATGCACCAAGCTCGAGATGAGTATATTCTAAAGAACGTTGTAGATATTTTTTGTCCAACTTACTCAGCTGATAACC
AAATCCGGATTTACTCATGCGTTCAAGCATTTCGCTATTTACATAACGGTCAAGAATTTGCGTTGGCAAATTAGGAGCAATTTTAATTTGGTCTACT
TGATGAAGACGATAATACTCGTATGGAATTCCTTTTCTTTAATAGGAATGAACGCTGGAGAACGTTCCAGACCTTCCATAATAGTACTTAGTCCTG
CAGGTTTAAGATGTTTTTCATGAAAATCAAACATCTGATAAAAACCTTTCCATGTAGTCGTACGACCAATCCAACGGTTGATATTCATGTTAATTTC
AGAAACATCTTTCCAGTAGGTTGACCGAACCTTCGCAATATCCATAGGAGGCTGAAAGTTATATACTGTCGGTGCTTCTTCAATATCATCAAACAGA
GAAACTGTTTCAGGATACCATTCTTTCATCAGAACTTTATTAAAATCACCATTATCAGAATGGCTAAAAATAACATCAGCTCGACGAACAGTTTCTT
CTAATCCCAAATTTCGGCGCAAAGAAAGAGAAGAATGGTCATGTTGATAAACTACAACACGAACAGAAGGTTTAATGTTATCAATAATTTTTTATA
GTTATTAATAGTGTCTTCTTCAACCGAAGTAGCAGGAACTGAATTGATAATTAGAATATCACAATCATTTACCAGCTTAAGTGTTTTATCATATTCT
TTTGCCAATAAAACCGGAATTGAAAATGATTTATAATCATGCGCGCAATTACGAGTAAATGATTTATCTTTAGCATAAACCAAAGTTACTTCATGAC
CATTCTTAATAAACCAATCACGTTGCTCAAGAGAAAATTTAGTTACACCACAACCTTCAAGACCTCGAGCCATAAAAATACATACTTTCATTTAATA
TCCTCTTTGTTTTGGTTTATTTTACCAAAAATTTATAAAGCAATATAGGAGCCGAAGCTCCTATCCACATAATACGCCATACAGAGGCTCGTTAGAA
CTTTTAAATTTTATGCGCTTATATTTTATAGTTCCTTCTGCTTTAGCTTTATCATGAGACTCTTTAAAGCGTCTCATCATTTCCTCTTTAGAGGAAC
GAATTTTATTATAATCTATTTCAGAAGTCTCGGGTGTTCATCTTTCACAGTTGCCACCATTTTTGACTTGATAGGAATCAACCCACACTTTCATATT
AGGGTCTGCTCTTACAATAGGAGGATTAACTTCTTTAATTGAACTATCATGGTATTCTTTTTCAGAAATTTTCACGCAAAGATGACCATTCAAAGAT
TCAGTAAATCCTGCATTAATTTTAAGACGCTTGAATTTTACGTGTGTAAGCATCAATCATATCCTCAATCTGCGATCTAGTAGTCTTCCAAAGAATA
CTGATGAGTTCATCGTTATATGGCTGTTTTAGAATATCCCGACTTTTCTTGATAGCATATTCGTATTGAGCAAAATTATTGTTTTCAGCTGCAGTCT
GAGCGTGCTTATAAAGACGATTCAGTTCGCGTTTGTTTTTAGACAATAACTTATTTGCTTTTCTTTCTGCTTCAAGACGGTTCTTTTCTTCAATAGA
AGAAATAAGCTTTTCCACTTCATCATTAATTTCGGGTTTATCAGTCATATTAATTTCTCTAATATAAAATAAAAATCATCATCTGTTAAATGATACCG
ATAGTTTAATTCTACACCATTAGATTTAAAAGCGGTATCATACGGATTTTCTGGATCAATATCAATGTCAAGAGCTAAAACTTCCCTGAGATACATT
TTAAGTAAATAGGGAATAGCTTCAACTTCAGGTATTTCTTCCAAGAATCCGGAGAGGTTAATCGTTAGCCTCATATAAAAAATCCAAACTAGGAGAA
TCGTCTACAACACTTTTCTTTTCAGCCCCCGGTGTTCTATAGGTTGATTCTTCGTAATGCGTCATTTTATCGTAGATGTCTTGAATAAAAGTTTCAT
CTACTAACGCAACCATATCGTCGTCACGGCTGTCATAGACATTGTGAACGAAATAACTATATTTCTTTGCAACTTCCTTACGTTCTTTTTTAATACG
TTGGACGAATGCATTAAAACAAGCTTGAGTTATATATGCATGTGGGTTTTTATATTTCGTTTCATCAAAATTATGAAGCCCCTTAATAGAAGCTTCT
ATACCATCTGCAATCATTTCTTGTTTCCAAGACTGGGTGTATCCTGAAAAGTTGAAACGTTTAGATAAGCCTTCTGCAATAAGCATAATGGCTAATC
CGATAGTATCATTCTGACGAACTACTTTATTTGGGTCTTTATTATTTGCTAATTCTGTTTTCCAATCAATAATAGCTTGTAAAAGCTCTTTATTGTT
TACGTAATTATATTTAGGCTTAGTTTCTGACATTTTCACCTCTTAGCTCAATTCATAGATCTATTATATCATAATATTTGAAGATCTATCTTAAAGC
ATAGAGGATATCAGTTATCTAAGTAAACAATATGCTTGGAATACTTTCTCCATCCTCTTTTTAAATTCATGAAATATCTATATAATGACTAGTTAAAT
CAGCATGATATAAAAAGTCTAAAAACTTTTCATGTGTGCTAACGTATTCACTTTCATTTAATTCAGAAACATGACTTTCCCAATATCCAACACCAGT
CTTATTTGGGAAAAATGAAATTTTCATGTATTGGTCAACATAGAAAATGCCATAATTTTCAATAGTAATAGAAATATTAATAAATTTCATCATTCA
TCAACTTAGCCGCTTCAAGAGCTGCATCTAGTGAATCAAATTGATCAACATATTCAATCAATTCGCCGTAATTGGCATATAACCACCATTGGCTAAA
TTCATACTCAAGGATGAATCCGTTTCCTTCAATTTGAGTTAAACCAATGCCATTTGTATTTACTTCATACCCAGCAAGACGTAAATCGTTAATAAGA
GCTTCGTTCATAATTATACCTTAGTAATTTTCAGGTCTGCAAATTTTTTCTTGCGTTGATTTTTCATACGACGAATAGTTTTATCGGAAATTTCATG
CTTTTGATAAGCTTTAGATTCTACACCAAAAGCTTAACATCAAATTCTGACAAGATATATTGAACCAACAATTCACGGACAGTATTGCGTCCAATC
TTCTGATCATTCTGTTTCATCGTCTGATGAAGCTCTTTTTCCCATTTATCCAAAATTTGAGGAGTTACAATATCGCCTTTTTCTAGCAGAGAAACTA
CTTTATCATATGCGTAAGAATTGATGGCGTTTTTAATTTGAATAGTCATACATTATCCTCAATTGCATTAAAATTTTATTATCCAAAAAGGGCCGAA
GCCCTTAGCTAAACTTTTTGGCGCCCTTCCAGCCTTCGTACATCATTGCGACTGACAATGACAAGGCTCCTTCGCATGCTGCATACTTATTATTCCA
GAACCAATTTAGAAAAACTTCGTCCTCAATACCATTGTGTTTCATGTTCTGGAAAAATTTGGCGCGTTCTTCACGAAGCTTTTGCGATAACATAGAT
TCAGGATTCATTTAAATTTTCCAATTACCGTTTTCATCAATGAATTTAATCCAGTCATTTACTGACCACTTAGTTGTATCGCCTTTTGGAGTAGCAT
TTAAAGTATATAGCCCTTGCTTAAAAAGCATTCGTTTGATATTCATATTTTCCTCAGCTGTAACGATAACACTCGTTTGATTTGCGTTTAGCAACTC
GTTGAGAAGTATTATAATCAAAATCATCGTCAATGTAAACTGATTTTTTTCAACTTTCTTACTTCACCACGTAATTGACGATTCAATTCATTCTTAAC
CTCTGAATCAACACCTCGCATACGTCGCCATTTATCTGAGCGAAAAATGTTTTCAACCATATCTTTATGACTTACACCATCAGGAGCTTTACGCTTT
CCGAAATAGTCATAATCACGCACTTTTAAGTCTTTACGACGATACGTTTTACCCATGGAGTTTAATTTCCTTAGCAACTGAACTAAATGCAGCACGA
TCGCAAATCATGCGTTTATGTAACTTGAGTATAATATAGCAAACTTCAAAACTATTTACATGAGTAACACGAACAGCATTACCATTAATGAGATAAT
ACTGTCCCTTTTTAATTTCTTTATCAACCATAACCATATCAATTCCTCAAAGGTAATTCATATGTTAATAATACCACAGTTTGAGCTCGTTGTAAAC
AACTTTGTGAAAATTATTTTAGGGAATGATAAGAAGGGAACGATAGCTTAGAATGGTAATATACAGAATGTAAGAAAGAAAGGCCCAGAGGGCCCGC
CTTAGTCTTCTATGATATCTCTATCATATCCAAGTGAAATGAGAGTTTCTTTGAAGTGTTTAATGTTCTTTTGTCTAGAATCATTGATGAAAATGAC
TGGATAACGAATGTTAAGAGATGTGAATCCAGCGCGTTTAGCAAGAGATACAATCAGTGGACGATCATACTCAATCTTACCATTATTTGTAAGAACT
TTATAGAAAGTAAAAGGAGCATTAAGCTCCTTTAGAAGTTTTGTAACTGATTGACATCCAGGACAACGACCTACTTCATCTGGAATTCCATAGACTT
CAATCTTATTCTTTAAGTTCGAGTTTTGTTCCACGAGAAATAATTCCTTGATAAGCCCAGTATGCGGGTTAACAGAATCATCGCCAGAATTTTCTT
CAGGAAAATAAACCTGGATAACAAATCCAGATGCATCAAAGGTAAAATAAACCGTAGGTAATTCACCTAACAATTCAGCGCGGTTATTAATTTCTTC
AAGTTCTCGTTCTCGTCCAGCCCAAAAACTAGGATTTAGACTACATTCATAGAAATAATAGTCATTACCGAACATATCAAAACCCTTCCAACTCTCT
ACCACATATCGCTCAAAACTAATCATAATTAGGCCTTTTATCAAGAACGCATTCAGTTTGTTAGTAATTTTATCCAGACGCTCATTGAACTCGCT
AGAAGATAAGCCTTTTTCTGGAGAAATTAAGCTAATCACGAAAAATATAGCAATAAAAGGAATAAGAAAAATAGCACCAACTGCCATAAACAAAAG
AACGTTACAGTTGTAAGAAAATCAGCTAAACCTTTACGAAATTTATACATATTTTACCCTTAATTGATTAACCAAGCATTGATAAGCACTAAACTAT
ATTGCGAATAAAATTCTGGACCAAAATGAAAAATCATATCATTTATAGTATCCATAATGTAATTCAATTTAATCATGTTTCCACACCCCATCGGTAT
TTGACCAAAGTCGCTGATTATCTGATCCTCGCCACAGCTTTTTGGTCGGAAGATTTTTCTCATACTTCCCATCAATAATAACATCAACATATTTAAG
CATTTCTAGTTGTTTAATATCTTCAAACTTATATCCTGTCCACAACCAAATGCTTTTATTTGGGATAAAGATTTTTTAATAGTTTGAACCACAGAGTGA
ATCACGTCTCTGTTATCAGGATAGAGAGGGTCACCTCCGGTTATAGTCAATCCTTCTATATAATCATTATTCAAACATTCAATTAATTGTTCTAGTG
TTTCACCAGTGAATGGAACACCATTTCTAGCATTCCATGTTGATTTATTATAACACCCTTCACATTTATGCAAACAACCTGTAACGAAAAGAACGGT
```

Figure 14(M)

```
CCTGCAGCCAGGACCATTAACAAAATCGCAAGGATAAAATCTATCATAATTCATTGGTGCTTAACCCTATGCATGATTTCTTTATTTTTGCCGAGAT
TAAATCCGCGTTCGTTCGGATTTCCCAAATAGCCACATGTTCTTCTTATTGTGTTCATCTTTTTAGGATCAGTTTCTCCACAAATAGAACAAACAAA
TCCGTTTTCAGTAGGAGTCATTTCATGGGTACTTCCACATGTAAAACATTTATCTACTGGCATATTAACACCAAATAATCTAAATGTTGTGCAGCA
TAATCCCAGACAGCCTCAAGACCTTTTAGGTTATTTTTCATATCAGGAAGTTCAACATAAGAAATGTGACCACCTGTCGCAATGAAATGATATGGGG
CTTCGCGAGAAATCTTTTCAAACGGAGTAATATTTTCTTCTACTGAAACATGGAAACTGTTAGTGTACCATCCTTTATCGGTAACATCTTTTACACT
TCCATATTTTTCTGTATCAAGTTTACAGAAGCGATAACAAAGGTTTTCAGCAGGAGTCGAATACAAACTAAAAGCAAATCCGGTTCTTTCAGTCCAC
TGCTTAAGATGAGCATTCATTTTAGTTAAAATTTCTTGTCCAATATCACGACCGACAAGAATATTCAATTCATGAATACCAATGTATCCTAAAGACA
CTGAACTTCTACCGTTTTTAAATAACTCAATTATGTCGTCATCAGGTTTAAGACGAACCCCGAATGCACCTTCTTGGTAAAGAATAGGAGCAACAGT
CGCTTTAACTCCTTTTAAGGAACTAATTCTACACATCAAAGCTTCAAAACATAAATCCATTCGCTCATTGAACAATTCAGTAAATTTCTGTTCATTG
AACTGTGTTCCAATATAAGAATCCAACGCAATACGAGGAAGATTCAGTGTTACAACACCAAGATTATTACGTCCATCAAGAATTTCATTACCGGTTG
AATCTTTCCACGCACTCAAGAAACTGCGGCAACCCATTGGAGAAACAGGAATAGATGAGCCGGTGATAGCTTTATTGTTCTTAGCTGAAATAATATC
AGGATACATCCTTTTGCTTGCACACTCTAGAGCAAGCTGCTTAATATCATAGTTCGGATCGTCTTTATAAAGATTAACACCTTCTTCAACGAACATA
ACAAGCTTAGGGAAAATAGGAGTTATCCCATCACGACCGAGACCTTTAATACGATTTTTCAGAATTGCTTTCTGAATCATTCGTTCAGTCCAGTCAG
TTCCCGTACCAAATGTAATTGTTACAAAAGGAGTCTGTCCGTTTGAACTAAAGAGAGTATTTACTTCATATTCATAAGCTTGGAATGCATCGTATAC
ATCTTTTTCTGTTTTAGATTGAGCATAATTTAACGCATCAGCGATTTGCCATTTTTCTGCATCCTCAATATGTTTTGCATAGGTGCGTTTAACATAA
GGAGAAAGTACTTTATCTACATTCGCAAAAGTCGTTCCGCCGTATTGGTGAGAAGCAACTTGCGCAGTAATTTGTGCCATAATTGCAGTAGCAACTC
CAATTGATTTAGGAGTTTCAATCTGTGCATTACCAAGCTTAAATCCGTTTTCAAGCATTCCTTTTAAATCTACTAAACAACAATTAGTAAATGGAAG
AGCAGGGGAATAATCAATATCATGGAAATGAATAATTCCGCTTTCATGCGCTTTCATAATAAAAGACGGGACCATATTTTTGGCAATGTGTTTAGAC
ACAATACCAGCCATAAGGTCCCGTTGAGTTGGAAAAACACGAGAATCTTTATTAGCATTCTCGTTTAAAAGGTCTTTATTAGTTTTATGAATCAATC
CTTCAATTTCTTTTTCAATTGTCATTTTAAACTCTTTCTAAGCTGCTTCTTAAATGAAGCTATTAATTGTGTTTTAGTGTCAGATTCATTATATTCA
AATCCTCTTTGAAGCATCTCAGCCATCATTTCCTCTTTTCCTAAACGAGAAAATTCCTTTGATTTATCTCCAACAAAGTTAGGGTGAATATTATTTT
GGGTGTAATCGGATTTTAAATAAGTAAGTAAATTTTCTAACCATTCAAGATAATCAACACCTTGCCCCTTTAAGCCAGAACGATTAAATTTATGTTT
CATTTGACCTTCTGCGGCATTGCAGAGATTACAAAGCAATCCACGTACCTTTCCTGCTTTTGGTCCATTTAATTCATGGTCATGATCAAGATGATTA
GCTTGAACATCAGGATTTAGTTCTCGTTGGCAAATTAAGCATTTACCGTTTTGTGCATCATAAAATTTCTGTTTTTCTTCTTTGTATAATTTGCCAG
TCAATAACATAATAAACCCTTACCTTAAATAGATAAGGGTATTTATTATTTTCAAGTATTGTAAAACATTCGATGCAATCGTTTATACTGTCGAATC
ATCTTTTTAGTAGGACGAGAATAGGTTCCTACGCAAGTGGTCATATGAGGGTCCGTAGAATGTCCTTTAATAAAAAGTTTCCAAACCTTACCGCCAT
TTAACTTTTCAGTATAAACCAATTCGGTTTTCATTAAAATGTCCTGTCAGAAAAAGAATTTTGAGTTTTTTCAAGTATTGTAAAACATTTGATGCAA
TCGCTTATATTGCCGAATCTTTTGGTCAGAAAAAGAAATTTGAGTTTCAAGCCATTCAATGTACTCTGCGGCAGCTTGCATCAGGTTACCTTCATAG
CCATCGTTATTTTCTTGCGCAGCTAATTTAGCTAATGCGTATGAAATACGTTCACCTTGAAAAGCGGCTTTAGGCTTCTGAACATCTTGGCTAGTTC
TCTCTACAACTTCTTCAATTTCGCCATTTTCAACGGATTCAGTATTCCACAAACACCAGTATGTAATTGGCTTATCATAGATGTTAATAATCTTTCC
GTCGGAAAGTTCAATTTCAATAATTCCAGTATCAGGTTCTATATCATCTTCGCATTCTTTTGCAAGTTCACGAACTTTAAAGACAGTACCTGCACTA
AGTTCCGGCCAGTAATTACATAGCCCTGTATCAACACGATTAATTCTAAACCACTTATCTACTGTAATCATGCCCCATCTCCATATCAATTAAGTCA
TTTATCGTTGGTTCATTATATACTGTTTCTTCATCAGTGTAAACCGGTTCTTCCGGCTCTGGCTCTACAGTTTCCCATCTAGCCGCCCACCAAGGTT
TAACCCCGAAGCTTATTAAGTTCTTCATAATCAATCCAGGATTCTAATCCTGATGGCAAATACGTTCACTTGAAAAGCGGCTTTAGGCTTCTTCAATTTTCT
GAAGACGATCTAGTTCTTCGGCTGGAATAGTAACCATTGACGGAGCTCGTGATACATTAATATCGTAAATCATATTTACCCCAATTTAACCATACAA
TCGCCGTATTTCCACTTAGAAATAGACTTTTCACCATTAGAATAATAAACTTCGAGTTTAGCACGATTATTTTTAATTTGAATAACCTTTGCTGTCA
TCAAAGTTCCATACCCATAATAAACTGCAACTTCATCACCTACATATACCGCGCTTCCGCGGTAATCATGAATATAGTCATTTCCTTCGAGCATCAT
TTAAAATATTCTCGCAGTTGGTCAAATCCACCAATATGACTTCCATCAGGAGCAAATACCTGGGGCATTGTTAAGCCGATTTGAGTATCACGACCTA
GTTTAGTCAGAAGCTCAGCGATTTTCTCATCATCAAAAACACCTTTTTCCGGCATAATGTTGATAAATTCAAACGGCTGTTTCTTCACAGTCAAAAG
ACGTTTTGCATTATCACAATACACACATTTGTGGATGTTGCTATCATAACCATATACTTTAAACATATTATTCCTTAATTCCTAGTACTTGTTTAAA
AGTCTCGTCGTAATCAAGACTTTGGCCCGTTTGTTCTTTATGTTTGTATATAATATCACTTACTTCTGATAGCATATTTTTATATGAACGAGTTAAA
GCAGATTTAAGCACGCTGTATCTATCAGGAAATTTACCGTGTTCATTATAATAAGCTATTGCTAATTCACGGACTGCCTTTTCAGCAGCCTCCATAT
ATTCTTTACGCTTGGTCATTTTTAATCCAAAATATTATTAGGCATTGGTTGAACACTCACAAGTTCTTTAAAGAACTCAGTAGAGTCAGGCAATTTA
ACCATTTCCGGAGCATGCTTACTGAATTTATGTTTACATTGACGGCATTTATATTCAAGCTCTGGTTTACGCCAGTTAATCAACTGAACTTGTTCAG
TACCGCATTCAGGGCAATTAGGAACGTTTTTAGAAGCTCTTTCACGTCGTTCAACCATAGCCATAATAGCATCCCATGCTGGAGGTTTAAAATCTAA
ATCGTCGCAGCCGTGAATCTTTCCACGCATTTCCATATCATCTTCCTCACCAGCCATAATAATTTTAATTAAACTGGAATTACTTGAAGCTGCAATG
TCTTCTAATAAACGCTTTTTCATTTCAATACCTCAATAGCATTACGTAAACCATTTGCTTTTGCATTAAGAGCTTTTAACAATTTGGTGTGTTCTGC
AATTTGGGCTTCAACTTCAGTCAAACGGGCATTGAGATATTCACGTTCTTCACTCAGATTATCAACCTTTTCTACTTTAGGCTCTTTTACAACTGTC
TTATATGTATTAGGGTTCTTCAGTTTAATTAGAATGCGTGAACTGTATAACATTGAACCATTATCTTCGGTTTCGTCATACATTTCCACTACGTCCA
TAATTTTAACATCATGCGGAGTTTATAAGACAACGAACGAATAGTTTTGTTGTGCTTATTAATTTCTTTAGCTGTAATGGCGCCAAGATTACGTGA
GTAATAATAAGGAACCTGGATATTAATTAATACTGATGAACCACCTGGCTTGTGTGTTACTTCATCAGCAATAACCCAGTCCTTAACATGAACTGTA
TTTGTACGGTCATCGCCTGCAGTAAACAGCTTGCGAGCATGCTTAAAAAGCATATTCACTTGGTCATTGAATTGACAAGCAAATTTATCAGCAAATT
TAGTTTCAGGAATGGTAGAACAATCAGCCAAATGGGTCTTTTTAACATCGTTAACAATAGTAAATTCAACCAAATCAGTTATAGATGTCGCAGA
TTTAATGAAGCTCGGCTTCATAAAGTTTTTAATGTTATCACGAGCTACAGTAGAAGATAACATACGAGAACGTTTAAACCATTCAAGCAAATTGCCT
AACGAATGAGAATAAGCGTTTTGAGTATCTTTACAGATATGATTTTCCTGACCAACATATTGAAGGAAATCACGAAGAATATTATTGATTACTGCTC
TGTGCCCGATCTGATAATTACGGTGTTTAGTAATAAGGCTGTCAAAATAATCAATATAATGTTTACGAGTTTTCATGTTCTTCTCACTTGGTTAATG
ATTTATACTCCGAGCCATCCTTGGCTTTAAATTACTTAATTAACTGTAAAGCTTGTTCAAGACGATCAAGACGATTAACGGATTCTTCCCAAATCTT
TTTAGCCTGCTCATATTCTTTCTGCGCTTTATTAGAAATTTCTAGAACGTTTTTTATAAGCTTTTTCTAGTGCAATAACTTCTGGACGAATTTCTACT
GGTTCAGGCGAATCGTCAAGACATTCCATTAGTTCCTCAAGGGTAGTTTCTTCTTTAGGAGTATTCACAATTTCATCACATTTTTGTTGGTAAATTT
CTTTATCAGTCGGTGAGTACGCACACTTTACTTCACGGAGACTAACTACAATTTTATATCCTTCCAACCGCATATATTCTTAAAAGGATAAGTATG
AATATTTTCTACTGTTTCCATCAAAGTAATGCGGTCTCTAACTGACGAGTTATATCGCTAGCAATTGAGAAAAATTTATTAATGTTCTTTGATTA
GCTTCTGGTGTAAAAATTCATAATTCACAAAAATAGCTGCTTTATTTTTATCAAGCTCATATTCTTTTATGATAATCATATCAGAAGCCCAAGGAT
GGATTTGACGATAATCACCATAGCATAATTTAGAAGCTGATTTTAGAAATTTGCTTCTTGAAAAGTCTAAAATTACTAATCCAACGACGAGTAAAAT
ATTCTCAGGGTCTTCTTTATTATTAAGATGATAAGAATTAACATCACCGAACCAATTATATCCTACTACATCTTTAGTTCGTTTAATTTCTTTCCCA
AAATTACCAAGAATATCCCGATTAACCAAATATGAAAGAAGACGAGACTCTTTAAAGGTTTTCTTGATAACATCTTTATCTACACGGCTAGAAATTT
TACGAATTTCATGAATAAATTTAGTAGAAGAAACAATACTTGCATCAACACTATTGAGCCATTGATTGATAATAGAAAGAACGATATTTTGACCAAA
```

Figure 14(N)

```
CATCGGTATAGCTTTATCATCAATAACGCTATTGAATGATTTGATATATTCGTTACGAGTCATAATAATCTCCTCAGTAGAAAGTAAGAACATTATA
CCACATCCTTGTGGCAAAGTAAACTAGTTCAGTGCATTTAGTGCATTGTTCAGTTTAGAACGTTGCTTCGTGAGATTTTTGACTTTTTCTTGTGCTT
TTTCTAGCATCTTTTCAGCTTCTAACACTTCATTGGTCGCTTTAACGAGTTCATCATCTACTGCCTTAAGGGACTTCTCAATCGCATCCGCGTGCCA
TTTTTCAACAGGTTTAAGACTCGGATTTTCAATAGGAAGAAAATTCACTTTATTGAATTTCCATGCATCTTTATTACCTGAACTATACATCCAAAAT
TTAGGATCATTTGACGAGTAATTAGATAAATTTAAGTTATCTTGCACTTCCTGCTTTTTCTCTTGCGGGACTTCGTCCCTTTCTCAAAAAATCGTATT
TAAATGAAACGATCATATCAAGTTCATATGATGTTGTATCTAACTTAAATCGTTCAAAACGAGGTAAAATCTTAGATTGAACAGCAGCAACAACATC
CATATACTTAAATGCTTCTGTCAACTGTGATTTAAGACATTCACAAATTGAAAGAGAATTTTTAGTATTAGGCTTAAAGCTGATTCGCGCAGTTCGA
TTATTTTCTTTAGATGGTCTTACTTCCATTTGAAGAGTATAACCATCAAATTTCAGATTCTTTAAGTTAATATCAGAACCTTTTAATCGACTAGCCG
TAGACAAAATTTGCTTTAATTGTTTACGGAATAAAGCAATAAATCTCCATTCAAGACGATAATGATTTGGATTATAAAATCCCGTTGATAGATCAAC
TTTACTTTGACCAACGCCTTGAACAAGTAGAGGATTTTTATAATCAACGGTTTTACAGAAATCCATGAGCTGTTCACGGGCAGTCATTTGCGTAATA
TATCCAGCTTTATCAAAATGCCGCAACCATTCAGCGCTATTCAATGAGTTAAAGTGAATATTACGTGTAACTTATCAGGGTCTAAATTATTTTCAC
ATAAAAATGTTATGACATTACGAGTATAACTAGCATTACGAACCATATCTTCAATTTGAGAACGAGTTTTCATAGTATTCCTTAAAATTTAAGTAAA
TCGATAATTTTAATTAAATTTTCACGCTCAGATTTAGCTTTACTGCTTAATCCAGACAATCTAAAAATTTCATCGTCATATTGTTGAATAGAAATAT
TTAGCTCTTCAATTTGCTTATTAAAATAATCAATTTGTTCAGAATGTTTTTCGTTACTACGAACTGGTACAGGTTTTGTAGGAAATTTAGTTAAACT
GGATTCATCCGGGCGATAAATTAAAATGCAATTTGAACCAATCGGGCATTTAGCACCAGATGAATATTCTAACGTTCCAGCTTCTTTTAAAACTTCA
AAAGCTAAACAGAGATGATGCCCCATATTAACATAATCTGTAGAGCGAGCTCTGATATAATAATCATCGCCGCGAATACTAAATTTAAAGCATTTAA
GGTCTTCTGTATTATTGGTCTTAAAAATCATTTGTTTATCTAGACCTTTAGCTAATCGAGCGCCTAATGCTAATAATCGTCGTTGATTTCCCACAA
ATCTGCGATCATTTGGTCAAATGATAATTTCGGCATTAATCGACCATAAAGGTCATATCCTTTATTATAATTGCGAAGGATTTCACTCGCATTAATA
CGAGACAACGCTCCAATTTTATTAAGGGCTTTCATGATGCGATTAGATAAACCCATTCCAGACCCGTTTGTTCGTTGTAAATGTTTATCTAATCCAA
ACCCAATATCAACTTTAAATTTATCTAAAATTTCAGCATGAACATCTCTGTCAATAACATTCAAATCCAAAGTTGGGTTAAATCTATGAAAAAATTT
ATCTGGCTCTCCACGACGAAGTACAGTCCATTCATTCAATTTTTTATTAACTAAAGATTTAATTACTGCATTGACATTATTAATTACTACTGACATA
TTTCCTCACTCAATTTCAATTTTACTAAATACGCAGAATATGATGGAAAAGACTATATAAGCACCGCATACAGATTGAACTAATACCATTCCAAAGA
ACCAAACAATATTATCAAACAATGTCTGTTTTACGTCGAAAGGACGTAAACTTACAGTAATATTATCACCTTTTTCTATTGAAGAATACATCTCTGG
GGAAATATATTCACTAAATCTATAACCATCTTTGAGTTCATATACGGCAATAAACGATAAACTAGACCCTTTTCCTTGTGTTCCTGTAATGGTATTA
ACTACAGTAACATCATAATCTTTATAATGCATATAATCATTAATTGCGTAATAACCATATGCAATTACTACACATAAACAACATATCAATAAATTCA
ATCTTTTAATTATCAACTGTTTCATAATAATCTCAATTAAAAGGGCTTAGAACCATTATACCATCCTTGGTATAAAGCGGTTATGCGAGTACCGTCT
TTAACCGTTCTTCAAACTTCCGAAGAGTATTCTGGCGTTCAGCTCTTTGCTTTTTATAAGTTTCAATACGCTCTGAAATGAGAGTGTATCGTTCATT
TACTGATTCTTTCATAAAATCAGGAATTTCACGAGAAGCTTTAATCTCGTCAAATTTATCAATAACAGCTTGCTCTTCAGCAATTAAGTTATCATAC
ATTAAAATATCTTTCTTGATAAACTCAATATCTTCTTGAGTTACACGAGATAATTTAGATGCTTTATCCTTTTTGTACTGTTCGTTAGTATCACGAG
ACCAGTGTAATGTACGATTTTTATTCGTATTTTTGTAAATTTCTACAATACCGATCTCATCGATAATAACGATCCAATTCCAACGGGATTTGTAAAT
TTGTCCTCCATCAACAGTGATTTCACCTCCGATTGAGATGTCATTAAAGAACTTGCTTTGCGCTTCAGATTTAAATTTACCATCGTTGTAATTTACT
AAGTTGAAAATATCTTTAGCGTTCATTTTCTGTTCCTCCGTAGTTGATAGTTGTATAGTACCACAGAGGAACAGTCTTGTAAACCACTAAAAGAAAC
TTCTTTCACAATTTTTTCCACTGAACCATGCGCTTACCGCTTTCTTAGTCTCAGGAGCAGTGTTATCCATAAACCATTCAAAGGCAGCCTTTTTATG
ATTCTGGAGGGCTTCTCGGGCTTTAATCTGCTCACGGTCTATTAACAATAACGTAGCCCTTTCTTGTCACCATGGGCTTCTTATGATTTTTTGAA
TATTCCCAATCATTTGTCCATCGCATCGTTGTTGCGAATTGAAGTACAGCTTCTTTAATTTTAGTTTCGTAAATTTCACGAGCCTTTGAGTATAACA
TCATTACCTCCATTTACCAGTTTAATTCTAGTCATCTTTTTGATGGCAGTCCATATAATCTATTTCTGAACTGCCTTTTTGTCATAGAAGTCCTCTT
ATGAATTATTTCAGAAGAGTAACCTCAGCGATTTCTTCCCAACCGTTTTTGTCGGTCATAATAAAGTCAGCAAGATAAAGAGCAGTACGCAGTGAAA
CATTGCGTAAACGATTAACATTGACTTTCATCCATGATAATGCTTTATAAGTTTCTTCATCAGAAAGACCGCGTTTTTGCATCATGTCAGTTGAAAG
AATAACATCTTCAACCCTGACCATAATTTCTTCATTAGTGTGAACACCCAAATCTAAATAAACTGACGGGACACTAATGCTTGTAAATGTGGAGCA
AGTTTAGTACCACGGTCTAATTCGCGGTCAATATCAACGTTTGTGATAAAACAATCGTTCCTTTAAATTCAAACTCACGCTCAATGCCTTTTTCTT
CTAAGTAAGAAGATGCGGTGCTCCAGCAGACTTTACGGGTCTCTCCAGTGTCCAGAGCAGCTTTCAGAAGATTAAGAATGTCCATATCAGAGAAAAC
ATCCACATCATCAATCAAAAGGACAGAATTCTCTTCACGATTATTCCAAAGTTGTTCATAAAGACCGATACCGAGATTTTACCGTTAATGCTTTTA
TATTCAATGTATCCATTATCATTTGCTTTATTCAAAGCTTTATCTAAAGAATACGTTTTACCAATACCCGCCGCCACCAGAGATAATTAATGAACGAA
TGTTTCCGTTAATAATACCATTCGTCATCATTCCCATAACATTAAATCTTTTATTAATGCGGGTTTTCATATCTTCATATGATTCTTTAACTTCTTC
AACTTTTACACCATCATATGAAATGTCTGATTTGTAAACCCAAACACCGCGACGCTTACCGTCAATTTCAACAAAAACTTTACCATCTCCTTGTGCA
TCTACCGGAGCATTATCTGGGAACCATTCACCTAAGAGCTCAAAAGTTCCAGAGATTTCTTTACCGAAGTAGAATACCCCTTATTGATAGTTACAGTTT
TCATTTTATTCTCCAATCTCACATTTGTTTTGATAGGGTAATAGTATCACACTACTACCCTTCTGTAAACAATTTATTTTAACGTTCGCCAAATTTT
TACTGCTTCACGGCGAGATACTTCTACAGCTCCAAGTTCTACAGCTTTTTGGCGTCGGCGAGCGTGTAAGTCATAATGTTTAATGCGTTTATCTTGA
AACCAAGAACGTTTCATTCCTATTGCTTCTGCCATTTCATGAAGCTCTTCAATATCTCCATCAGTGAACATATGACAATTTTTAGTTGGATGACCGC
GAAGTTTCCATCCATGATTCATTAAAACATCTACGTAAACTTCATTGATTCTTCTCCAAATAAGTTTCTTGATAATTTTCTGAGCGAGATAAACTGCA
TTATCTTCAGTTGCATCTTCTAAGAAACTTTCAAAACACTCTGAAATTCTTCTGTGTCAATCAACTTTTTTACTTCAATTGGTGTAATTTTCATTT
TGTTTTTCCGTTTAAGTGTTTGTTTTGATAGTTGTATAGTACCATAAAGCTTTATGCTTGTAAACAATTTTGTGAAAAATTTTGAAATAAAAAAGG
GAGCCCGAAGGCTCCCTATCATTTATAATAACTTCGGTGGTTTTCAAGATAGACCTTCTCAAGGAAGTCATCCCAGAAACTCATGTCTACTTTTTGC
TGCATACCGTTCTTAGAAGCTTCAGTAGATGATGCTTCTACTTGATCGACCACATCTTCCAAAAACTCTTGAACTGTTTTAAATGGATGCTTACCCA
ACTTCACGTCGAGAATAAATGGAGCATCTTGGAGTGGATAAATCAGTCGCCAGTTTTGTAAATTTCCAATAGTTGGAGTCCACCACGACAAGCATG
ACTCAAAGCTTTCCAGTCAATACCTTCATTGGCTTCGGCCTTACGAGCACGTTCACCATATTCAGCATCTAATTTGTTCAGTGACTGCTTAAGCTCA
ATAAGAGAAAGCGTTGTCTGATATTTACGACCCAACACAGTGTAGAACGTTTGTGGGCCTGTTTTCTCATGATTATGGAACACCCATTCACAGAATT
CGTTTTCTGGAAGACGATGCTTAATATCTTCAACTTTAGTGCGACGCTGCTTAATAGAACCATCTTCTTGGTAATCAATCCACTGCTCAGGGATTTG
ATTAACTACTTTCAATACATCACGTAATGCAGCCAAACGAGAACCTTTGACACCGTATTTAGAAGCTTGCTTGCGGACATATCCTAAATATGATTTC
ATGTTAGTCGTATAAAAACGAGAACGGTTCTTCGAATAAACTTCCACACATCAGGCAAATCAGATTTAACCACTAGTTCAGGTGGAGTGTGAAGCA
TATCCAATGCTACAGTTTCACCCATCTGCTGCTAATTTAAAGAAATATTTAAGACTGTATAGTTCATGGTCAATATCATCTTTAGTGTTTTTAGATGA
TGTGTTGTTAGTGTTTTTACTCATGTGCTCTTTAACATTTCCAATAAGAATATCACGAGCAGGAGGAACAAAGATTTCTTTAAAATCTACATCAGAT
TCTGGGGTAGAAGTTCCATAAAGATGACTACCAAAATAGCTTTTCATTACTGTTTTCATCATTCAGCCTTATATTCAATAACAGGACATACTTTAGC
TTTACGCGCTTTTAAAAATTCGATGATAATAGATTTCTTGGGTTGAATAGGAGGTAAACCTTTATACGCCCTATCAATATTTTCTACATGTAAAGCA
TAATCCTTTTTCCATTTATAATCTTTATATTTTTCATGCAGTTGTGCAGGAATAACAAATGAACCAATAATAAGTAAAATAAGCAAAATGGCAAGTA
TAAATGCTGATGGAATAAGAGTCCATAAACTACCAAAAATAAGCCATTTCTGTATGATTTCTGCACAGATAATAGTTAGACCTGCGAGTATAGTACA
```

```
ATCTAATCAATTTATTCATAGACTTTGAAACTTCTGCACGAACCTCATGTAGATTTTTGAGCTGTTCAAGACGCTGCTCATAGTAAGCAATTTCATC
TTCTTCGAGACAGTCCTGTGAATCTTCTTTAAGATAACGTGCATAGTCCTGGAAAGCGTTACGAACTACTTCCTGGAAGTCATCAAGACTTTGAATT
TTCTTAGGAGCAACAGATACACGACGAGGGGCAGTATAATACTCATAACCAAACCCTGCGCTTAATTGAGCCATTAGTATTTTTCCTCTGGTTGGAA
CGCTGCGCGACAAGCCCACATACTGGCTTCTTTGAGTTTCATTTTTAGCAATAGTTAACTGATCGAGGCTTTCGGCGTAATTCTTCGCGAGTTCATCA
TCTTCACAGCTATCAAATGCTTCCCAGAATTCATCATATAAAGCATCAAAGATAAGCCCTAAACGAACTTCAGCATCTTTGATAGCATTCACTTTAC
TGATTTTATCGTCAGTATGTGGTTTATAACCTTTAATGTCTTCAATCATATTTTACTTCCTCACCTGTTCCCAAATCATATTCAACTAAACGAATAG
GTTCATGAATGCCATATCCTTGAACAGAAATTTCTGTCGTAGGATAAATTCCATTAATATCACCCATGTTCCATGCTTCGTTAAATTGCTGTTCGCC
TGAATTACTAAACCACTCGGCGAAAGCATTTAGCACATCTTCAGAACCTTCAATAATTATCTTTGCCATTACAAACTCTCGGTGAAGGTACGAGCGA
TAACGTCGCGCTGCTGTTCCGGAGTCAGAGAGTTAAAGCGAACTGCATAACCGGATACACGGATGGTCAGCTGCGGATATTTTCCGGATGCTTAAC
TGCATCTTCCAGAGTTTCACGACGCAGAACGTTAACGTTCAGGTGTTGACCACCTTCAATTTTAACTGTAGGCTGTTGCTCAATTTCAATTTCACGG
GCATGCAAACCATAGAAAATTTCTGGGTCTACAAAAGAGTCCTCTTTAAAGGTTTTAGAGACAATAATTCGTGCTTGAATACCATCTTCAAAATAAA
TAGTACCTTTATGTGTGCCTTCAAGAATTTGATATGCTTTCATATAACCTCAATTAGAAAATAAATTTATCCAAGATTGTTCTTTAATTAAAAATGG
CTCAGAATCATATGCCATTAAACTCTGTGTGATTAGTCCTTTAAAAGGCCCATCAATAAATTCCATGGTAAAATATGGAATTTTATTCATTAGCCGT
GCATTAGGAGCCGTGCACAAAACTCTGCATCCTTTGAATACGCCTTTTTGTAATTTGTATTGCTTGGGATAAAATTCGCTCAAAATGTTATTTTTG
CCAAATTTCAAAATGATTCACCAATTTATTTTTAATAGTTTTTGGCGAAAAATAAAGATATTCGAAAAGCTGAGTGTCTGTCATCATTGCATTCCG
ATTACGAAAACTGTGGACGAGTAATACCACCAATGCAACATTTAATATTACAGCAGCAGTGTACAGTGTCAATATGGACACTATAAATCTTATCCA
TATCAGGAGATTTGACAGGCTCATCAATTATATACAAAATTCGCGAAAGCGATAAACCTCTGAACTTGCTTCCTTTATTACCAATAAAACTGCGCAC
AGAATCAGTAAATAAACGAAAACGTATATCATCATTAGAATAACGCGAAAATTCCTTTTTAATATTATCTGCGGAAATTTTAGCGTAAGCTGAAGTA
TTAGAAAGAACAATAACTGTTCCACCGTCATACAACCAATTAGCGGCCAAAATTCAATAATTTACTGCAGTTGATTTACCAGATTGACGCCCACCATCTAGTC
GAAGTGTACAATACTGTTTAAGTAAGTCTTCAAATGGCGGGATATATTCGTTTTTACAAATTTCTTCTACTCTAGCATCAGAATGGTGTGTAAAAGC
ATTCATCAGGGATAGATAAGGACCAGTTAAAAATGTTCTCATTTTGTTCTCTCTAGGTTTGGGCCATTCCATGGCGCATGAATTGTCCATTTCTGTA
TTTACCCATTACCGCACTTGGGCTCGACCTTATTACAGGTTGGCGGGAATCCCTCACAGAATCATGAGGTCCAGGTTATTCCCATGTTATTAAATG
TAAATATTTTTGCCGTAATACTTATACCAGTGTGGCTTCATTAAAATTTTTTCATCGAGTCGTTGTTGACTCAACTTAATAGCTGATTTGCATGGAT
TATAATCATTTTTCCATTCTACTGGAATATCGCTGATGTCAGGAACTTCAGTATCTTTTATACTGAACCCGCGTTTTAAGCATTCCGTTATAATGTC
CGATTGACGCTTTCGCAAAAATTCTAACTTATCGTAAAAGAAAGTAACATGACCAGAACCTAAAATAAATTTAGAAGATATTTTAAAATCTTTAACG
CGCTTACCGTTTGCCACATGCTTACGAACTATACCAAAAACACGCGGCAATTCACGGTATTCTGCGATTAAATGTTGATCAGCAAGTTCAGATACTA
AAGTCAAATTAATACGAGTCATTTTATCCCTCCAAGTAACTGTGAATATACTATCACAATTCTAGGAGAAAGTAAACAACTTTATAGATTTTTATAC
GCGTCCCAAGTGCCAGTTCTAAACGTTGCAATGACTCGTTTTGCGCGATTAGGTGTTTGATTATACCATCTACTTTTAGCTAAGTTAACTGCTGCTT
CATCCCAGCGTTTTTGCTGGAGCATGCGTAAAGAATTAGTAAATCCTGCTACGCCGGTTTCCCCCATTTGGAAGACCATGTTAATCAATGCACAGCG
GCGAACAGCATCAAGAGAATCATAAACTGGTTTTAATTTAGCATTTCTCAGAATTCCGCGAACAGCAGCATCAACATCCTGATTAAAGAGTTTTTCG
GCCTCATCTTTTGTAATTACACCATTACAATTACGCCCAATAGCTTTATCTAATTCAGATTTAGCAACACTTAGTGATGGACTTTTAGTAAGCAAAT
GACCAATGCCAATAGTGTAATAGCCTTCTGTGTCTTTATAGATTTTGAGTCTAAGACCTTCATCTATACGTAACATTTCAAATATATTCATAATACC
TCCTAAGTATTTATAGAAGGTATTTATAAATTAAAAGAGGCTGTTCATTATTCGGTAAAGTGAAGGACCCATCACATATTGCCACTGAGTACGAGGA
ATAAGAGCAAAAGCATCCATCTCTGGAATCATAACGCCATCTTTATTTTCAAAATAAGACTCGCAATGGCAATTTCTAAACATCTCATGCTCTACTG
GAATCGTATAATAAAATAACTGTAAGTCTTTATTACTAAGATATTTAAATACACCTAAGTCTTCTAGAAGGTCTGGATTATAATCGATAAAACCAGT
CTCTTCTGAGCATTCTCTTTTTGCAGCTTCCAGTGCATTCAAATCAGAACTTTCTACACGCCCTTTGGAATATCCCAGCGATGTGCAATCATTCCA
GGTTTACGAGAACCGGTAACTCGTCCCATAAATAAATCTTTATCTTCTGTCATAAAGATAATACCAGCTGATAATGTTTTCATTTTAATTTCCTGCA
TTCAGTGATAAAATTATTTAATTTTTGAGCATATTTCTTTTCATCAAAAATCTTTTGTTGTCTGCGTAGCCGCCATGGCATTTCAATGAACGTGTAC
CATATCCCAGATAATATTGATGCTGTAAAAATATTAACAAGTATGGTTAAAAGAATCCAATCTCCTATTCTGTCCATTGGATTTTTTATAAAAAGT
AAAATACGAATGATGACACAGGAAGACTAATGATATACCACAGAATCATAATCTTATCTGTGAACCATTCAGCATTCGTTAACTTAGCACGACCATT
ATGAATACACACGAATTTATCATCTGTTACAGTAGATGGCTTAACTGCTTGATATCCCATTCTAAACTCCCTAATTAATCGTTTCTTTGTATCTTCA
GAACAGCCGCTCCAGTCAACTCTATCAACTGAAATGCCATCGTCCCCATCATCTAAATCATACCAGCGAGTTTTTAAAATCATTTAATTTTCCTACA
ATCGCTCACAAACTCTTCCATTGATTCTTTTTCAATATAAGACATATAGCTATTATATTCCTTTAATTGTATTTTGTAATCCTTTTTTCTTTGCCAA
TTTATTTTAAAATTATCATAATGAAAATATAACATGGTACCAAAGAATGAAAATAATGAAATCGCTATAGTAAAACGAAGTTCACTCCAAACCTCTG
TTATAATTACTGTGCCGTCGATATTTAAAATAAAACAGTCAATTAACAATCCAATAAGACTACCCGCAAGAGCTGTAAATACTGATACAGCAAGAAT
TAATAGTGCCTCAGGAAACGAATATTTGACTTTATTTAGTTTTGGCTTTTGCATCGTGATTCCTTAACAAATTTCATAATTTCATCAAATTCATACA
TATCTAGCTTAAGCTGGTGTTCCTTTTTAATCTTTTTACACTGAGCTTTCCAATCACGTACACGTTTACGATAATGTCTTCCTTGATACCAGTATCC
TACCCAATTTACAGGTACTAATAAAAGCGGAACTACCAATGGAAGAATTAGTGTTGCTCCAAATATTGCACCAGATTCAATATCAGTCATAACGTCT
ATAACCATTCCAGCAATCACCAGAATCACAAATGATACAACTACCACAGGACCTATTAACACATCAGTAGAAATTAGCTGACGCTTTGGTTCATACT
TCACAGGTTTACTTGGAAGGTATAGTGATGGCTTTGACATATTCTTTACATTCCTTAACAAATTTTTCTAATAATAAATCGCTTTCAAAATTGGGAT
TTTCTACGAATTTATCAAAAAGATCATCAAAGAATATTCTTTTTACTAAGAATACGCTTATTTTGTATTTGTTTCAGAGTCAACTAT
AAAAGTAAAGAAATATTTCTTTCCCTGAAATTTTACCGTAGTATCAATATAAAATAAATTTGATTTTTGTAAATTACGTTTAAACCATGCATCACTT
AAACTATAAACGCCAAGATAATCATAATCGTCGTTTAAATAACAAACCGTCCATTCAGGAGAAATGAAATCAGTAAATTCAACATCAAAATCACACG
TCAATGAATGAATTGATTCAATACTGTTAATGAGTATTCCAGGACGTATTAAAGACTTTTTACCTCTAGAAAATCTTCCGGAAAGGCTTTCATCAGT
TTCATATGAAGACCCCCAATAGTAATTACGTCCTTCTGCCATACGTTTAAGAGCATTTAGTAATTGATCTGGAACATCAACCTGTCTTTGGAACTCT
TCAAACATTGAATTGAAATCACTTTGCATTTTCATTCCTATTTACTCCAAGTAATAGGGGCCGAAGCCCCTTATCATTATTTCAGAGAATTAATATA
TTCCTGGACATCGGCAGAGGTAGTTTCAACCCCAGAAATATTGCCGTTAAAAGTTTCAACGCAAGGGTATCTTCAATATCAACCTTAGTCAGT
GCTGCAATTTCAACTACATCATCGGCAGTACTAATTCCAAGGGCATTTGCCGCACGAGTTTCACGGATATATTCCAATTTAACCGCAAGTTCTTGAC
GAGCATCATCTAACTCAACTACTTTCTTGGCGATTTCAATTCGCATTTCAGCATAACCGTCAGCCTTAGTAGTCAACTGCTCAGCTGTTCGACGATA
TAGTAAACCGAGTTTAGCATGCATTGTTACATCTTGGCCTTCGGAAAGAAGTTTACGAATTTCACGCTCTTTTGATTCGGCCTGTCGATTCTTTTCG
ATAACAAGTTCACGAATACGTTTTCTTCGTTAATAGATTTAACAGAAGCAGTTTTTAGATCTTTAATTTTATCAAGTAGTTTTGCTGCTGCAGCAG
TATACTGTTCTTCGACAGATAGATTTTTAGCCATAGCAGAACCAAGTTAGTGCGAATAAACTCAACAATTTTCTTCAGTGTGTTCATAGTATTTCC
TTAGGTTAATTGAGATTTAAAATCCGTAGGAGTATAATACTCTATCATCAAGTTACAGGCTCATAATATCTCAATCATGAGCCTATGTAAACTTATT
TCATATTATTAAAATATTCTTCTGCGATTTCGTCGTTATCGTGGTAAACTTTAGAAGACAGTTTAACATAACCTTCAGCAGTGAACATATTAATCAC
AACCCTTTACAGTATACCACTGTCCGTCTTCATTACCCATTACTGCGTAAGTTTCAAACATCGGATGGTCAGGACCGATAACTTTAATATCATTCACT
GTACGACCAAAATCTTCTGAAACGCATTTCATAAAGAAGTTGAACAGTTCGCCGTAATTATCCATTTCATTCTCCAAGTTGTTTTTCTGTATCAGTA
```

Figure 14(Q)

```
GTTGATAGTTGTATAGTACCATGGAAGAACAGGGATGTAAACCATTTTGTGAAAAAAATTTTTAAAAGTTTTAGGGAATTCTAGGGAGGGATGGGCA
ATTAAAGGATAGGATAATATATTATAAAGGGTATAAACTAAATGATGCCTAGAGAGGTCCAGAAAGGCCTAGATACCAAAAAGCCCTATCATTTAGA
TAGGGATTTAAAATTATTTATCTAGTTTAGTTATTATAGCTTCTGCAGCAGCTTTTAGCTTAGATGCGGTGTTAATACGATTTTTAATTTCAGTATA
CGCATCGCCAAGAACATCAAGGCTATCAGAATAAACACTTACACTATTGCGTTCGCTATTTGAAATAGAACCTTTAGTTTTGCGGTCAAAATCGGTG
TACACGTCTTGAAGATCGCGGGCTGCCTTCTTTGCATCATCCAATGCATCAAGAGCTTTATTCAAAGCATTAACGTATTTTTTAGTGTCGAACATAT
TCTTAGAAATTTTAACAGGTGCGCGTTCAGGAGTAGCTAACACAGATTTAGGAACCTGAGCGCCAGATGCCAATTTCTTAGAAATTTTGAAAAATGC
TTTATTGAATTTATTTTCTTGACTCATTGTAAAAGAACTATTATCGATGTTGTACATTTCAATAGCTTTAGCTTTCCATTTAAGAAAATCGCCGCGG
TCTTTTGCGGTCCAATTGGAAGAATACTTTAGTAAGATCTGCTTCAGATGGTAATTTTGCTGCTTCGGTTAAAAATTCGGCATAGGTTTTCATTTAAA
ATCCTTGAAATAATTTATCGGTTGGTTATTAATTATTTATTACTTTGTTACTATCCGTAGCAGCATTCTCTATGTGATTCAAACTAAAAAGCCCCAA
CCTTTCGGTCGGGGCTAAGAATGTCATTTGATTTGTTTAGCAGACCAAATGCGGTCTTTAATAATTTTTGGATGTCTTCAACATACTCAAGAGAGT
GAACATGTGGATTATCTTTGAAACTATAAGCACGGGCTAACTTTTGGCCTTCGGTTTTGATTACTAAAAGCTCTTTAAGGATAGCTTCATATTTAGC
GATAATTCCTTTAACGATATTTTTTCTTGTGCCGCTTTAGGATCTGCTTTAGGAGCAGGTTTACCAGAAGCCTTTGCAAAAGCAGCGCCAGTAGCA
ACTAGACTTTTCCAGGCCATACTAACTGCATTTCCCGTAAATCCTTCTGCTTTCATGTCGCGAGCAAATTGGAATCGTGATTCGTCAGAAGCATCTT
TATAGGAATATTTACCCGCTGCAATGGCTGCTTTTGCGACAGCTTGAATTTCGGTGCTAGATGCTTCATTTAACACCGCTTCATTTAAAAATTGAGC
ATATGATTTCATCTTATTTCCTGTTTTAATTCGTGGATTTAATATACTACTGTATTTATACTAAAAAGCCCCAACCTTTCGGTCGGGGCTAAGCCTT
GCGGCAACCTTGTCGGGGTTCCACCTGCTAAGGCAAGTGTTTGTACGAAACGCCGGGATTTGAACCCGGTTATTAAGCAGTTGACGCTACTCAATAT
TTTTTAAAAGGCCATATCTCGACCATATCCGAACGTTCCGTCAAAAACGCTACTCGGCTTACGGCAAAGATATTTCCTCGAATCGATAATTCGGTGCG
CCGTTTCAGCTGTGATAGTAAAGAACCAGAACATAGTAAAACTGTGGGAGGAACTATACTCCAGGGAACATCAGTCCGACGACTTACCGGTAGCGAC
CCGGTTTCTTAATATTCTTTTAAAGCATCAATATGTTCACGGCATTTACGCCATAAATCAATTGCTTCATACGCAGATTCAGCATTTCGAATTGGAC
GGCATTTATATAAAGACTTGTGATTTTGATATTGCGTAGATAACGGAATTTTATCTAAAAGGTCTTTATGTTCAAAGTATTCATAACCATCTAAGCC
AAATGAACGATTTTTAAGAAATTTGCCAATGACCGTATTCGTTTTCGACATAAACATAATCTGCATGCTGATAAAGCAAATTAATTACACGTTCAGAA
ATAACAGTATCATTATGATTAAAATAGAATGTTAAATCATGAACTACTAAATAAACATTACCTTTCATATTTTCCTCACTTATAATTGGTCGAGGCA
GTAGGGATCGAACCTACGACCTAGGACTTAGAAGGTCCTTGCTCTTCCTTCTGAGCTATGCCCGTAATTGGGGTGACCGATGGGAGTCGAACCCAT
GACTACGAGAATCACAATCTCGAGTTCTACCAACTGAACTACGGCCATTAATACCTACTCCAACAATCAAGATGTCTTCACACGAAATTAAGAGA
AGAGTGATCAGTTCAACCCCTATAATCGCGTCAAGTAGATATTAATGTGACAGTTGTCACAAATTTGGCTGACGTGATAGGATTCGAACCTATAACC
AATCGCTTAACAGGCGATCGCTCTGCCATTGAGCTACACATCCAAATTGGTGGGGAGTGATGGAGTCGAACCACCCGAGTCGCAATGACAATGGATT
TACAGTCCACACCGCTACCTCTACGGGATAACTCCCCAAATTAATTTGGTGGCCCTGGGTGGAATTGAACCACCATCTGGCGATTATGAGTCGCTTG
CTTGAACCTTCCAGCTACAGGGCCTTGGTGCTGATTGACGGAATCGAACCGCCGACCTTCTCATTACAAGTGAGTTGCTCTACCTACTGAGCTAAAT
CAGCAAAACTGGCGGAGGCGATAGGATTTGAACCTATGAGTCGCCGGAGCGACTGCCGGTTTTCAAGACCGGTGCATTAAACCACTCTGCCACGCCT
CCAGTCTCCATACAAGGATTTGAACCTTGGACCTCCTGATCCCAAATCAGGCGCTCTACCAAACTGAGCTACACGGAGTAAATTAAATTGGAGCGGA
TAATGAGAATCGAACTCACATCATCAGATTGGAAGTCTGAGGTAATACCATTATACGATATCCGCAAATTTGGTGCGAGAAGTGGGACTCGAACCCA
CAAGGAAATCATTCCGCAGCATTTTAAGTGCTGTGCCTTTACCAAATTTGACCATTCTCGCGCTGGGAATAAAGGACTCGAACCTTTGCATCCTGGAA
TCAAAATCCAGTGCCTTACCAACTTGGCTAATTCCCAATTATTAACAAAGGCTCTCAAGCAAGAACCCTTGATGATAGAGGGTATTAATCAGTGCGG
TATGAGTTAATAATAACAAATAATTCTTAAAGCAAATTAAACATTTTAACGGTCGGCAAACAATTTCTTCTTCTATATAAGAGTATTTAACACTCT
CAACTACACGCAAGAAATCATAGTCATAATATTCAGAAGCATGACCAAGAATATCAATAAGGCCTTCAAATATCTTATTACCATTCACAAAGAATAA
GTCAAATACACGTTCTTCATCTTCTTCGGATTTATTACCAAGGTCAACTTCTATATCAAAGACCTTTTTAATGAATTCTGGATAAAGTTGTTCTGAG
AACAGTCCTTCAACCAAGTATTCATAAATAAAAAGCGATTGCTCGCTGAACAAGCCATTACCACAATAACGTTCAGCTTTAGTACTAGAATGTCTGC
TTTTTAAACTTCTTTAAAAGATATTGGAACTGTAAGATTTCATGCTCTTCTACGCCAAACAGTGTTTTAGTTTTATAGTTGTCACCATCATTTTCCCA
GGTAGTGACATCAATTACGTAGCCCTGCGGAATTGTAGTACCTAAACAAATATTCATTTTTCACCATGCTGCGTTAATGTAAGTATATTTAATACAT
TCAAGACCCAAAGGATTCTTGAAAATATCATATTCAAGAAGACCTTTTTCTGTTTTCAATAAAGAAATCAAAATTTACTGTATTAAATTTACGGTCTT
CCTTCACTAATTTAACTTGTGAAGATGAACGGTCAATGTAAACCTTTTCAACTTCAAAACATGTTAAAATGCCATAATCATCAATCAAAGCTTTAGC
CGCGTCTTGATCATATTTATATCCATTTTCAATGGATGATACTTTCGCATAAAGAATCATTATCAGCCTTCATCAACAATAGTGTGAGTATTAGCAT
TTACGATTTGCCACCAATCAAAGCGATTAGAATCCATCGGTTTGTTTTCATTTTCTTTGATAATGTCACGGAGTTCATCTTCAGAGAATGCTTTAGC
AATTAAATCGGTATACCCACCACGGGGATAATAATTATCACCTGCAAACAAAAGGAAATTTACCTTCCCGGAAGCAACATATGCTTCCTTAGGATAC
TTGTTTCCTGCGTGGTCAACCACTTCAATATAACGGTAAGGAATATCGGTTCTTTCAACCCATTGCCATGCCGCCGCAGGGGAATCGAAAGCATCTA
CACCTAAACGATTATCTTCATCTTTAGACGGATTATTTTCGTAATCCGCATATACATAATATTCAACGTTCATTATTCACCTTTAGAAATTTTATCC
ATAACAATAGCAATTAAACCAATTAAAAATGCTACTACAAGTGAAAAAACATTTTCTGCCGTAGTCAATAATCCGCATATAAATCCAACAAACATTG
AAAAAACTGAAAGCGGAAGCAGAAATTGCAATAGCAACATTTCGAATTAATTCACAACGTTTCATTTTATTCTCCTCAGTAGTAGATAGGGTAATAGT
ATCACTACCCTATCTAAAAGTAAACTTATTTTTTACGAAAAATTGATTTATTTTTCTGCTGCCCATTTTTCAATAACTGCAGCAGGACCAGTAACAAC
AATTTTATCACCGTAATCTTCTGCGGCGAGTTGACCGAAATTATCTAACGCACGAAGAACTCCATGAGGCATTTCACCCATTTTATCTTTCTTG
CCAGTGTAAATAAACTCAACTTTTACATCAGCAGTTTCAGCAATAAATTCTTGGTAAGTTTTCATTTTGATTTCCATTTGGTTTTGTTTTGATAGGG
TAATAGTATCACAACTAAAACCCTATGTAAACAACTTTGTGAAATTATTTTAAATCTTCTAATCGTTTCTTCATCTTAGAACCATTTTTAGCAATTT
CTCCTGCATCGGAGCATAATGCTAAAAGTGCTTTAACTTTAGTTTGGTCTCCTTTAAAAGATGAAGGATCGACCGCAGCAGCAAGTTCTTTAATACG
AGAGAAAAGACGCTCAGCTTCAGCTAAAGCCATTCCAAGCTTTACTTCCATACCGTGGGAAGATTCAGTGATAGTAGTTTTTATAGCAAACTCTTTG
AAAGTTTTCATTTTTATTTTCCTAATTAATTTTGATGAGGTAATAGTATCACTACCTCATCAGTATGTAAACAACTTTGTGAAATTATTTTAAATCA
TCTGCCCAATCGAGTTTAAGAGGCTCTTTGTATTCACGGTCAAGTACAACCGGAAATTTGTACATCACCGCTAAATGATAAGGGCCCAACATTATAAG
ACAATGTTATATCGGTGTGTAATCATCAAAATCGTGTGTAGACACCTAGTGCCCGCGCATACATGTGTCGACAGCGCAGATATTCAGAATCTAGCAC
AAGTACAAGAGTCGATCCATCTTGTGTTTTCCACACTTCTAAATGTCCAGAAGAAGCTACTTCAAAACTTCCACTCGATGGAACATATGGAACATTT
ACTCTCGAATAACATATGGTCGAATGAATTTTTTCTCTAGGAACTGGATTAGGAACACGTAAAGAGCGCTGGAGTTCTTCCAGCGCGTCAAGTGTTA
ATTCTGAAAACTTAGCTGCTACATAAAGACCCGTTGAAAAGTCTTTAAATTCCATCATTCTTCATCTGCAGATTCAGCAGTAAGATTCTTGACAGCT
TCAACGATTTCTTCAACTTTAATAGTATGCCGCAGTGATACCTACTTGCATGAGCATTCGCAGACAGTTTTTGTTCAATAGTTTGTTCAGACATTATAGT
GACGAGCCGCTTGGTCCTGCGTATCAAGAATACGAGATTTCAGAGTTACGATTTCAGCAGACAGTTTTTGTTCAATAGTTTGTTCAGACATTATAGT
ACCTTTAGTGTATTTTAATTTTAGAAAAAGTTCTTCAAGAGAACCATCGTTTGTAATTACTAAATCGCCATCACGAATTGGCAATCCAGCTTCTG
TAATATGTGTATCATTGGATTTTTGACCAGGACGAACTACATGAATTACTGTAGCACCCATCGCCCTAGCCGCATCCATTTCATGATCTTGACGGGT
ATCAGGAACGATATAATAATCATAACCTGAGTTAAATTTATCAAGATAATCTAAAGCAAATAATTTTACCCAGTACATGCGGTCGAAGTTATTAACA
ATCAAATCCGTACCTAGGGCTTGCATCAGACGACGGACTGACCATTGATCTTCAATATTATTTATAACGTCAGTAATTTTGTTAAATGCTACGAAAT
```

Figure 14(R)

```
TAACTGATTCTTTTCCTTCGTCATCAAAAACAAACACACCTTTAATTGGGCTTTTACCATTAAGATAGCAAAATGCTTGTTCCATAATCGTGATTAC
TTCTAATTTAGTCAGATTTAAATTAGTCTCACGATCATAGTCAATTCCTTCAAACTCTTTACGAGTTAAGCAAGGATAGTCGGTGTTTGCTGCAAAT
ACTCCCCATGCATAAGCCAATGCATCCTTAATAGGACCAGCAAGTTGGTATTTAACTGCAGAATAATTACTCATGATAAAATCAGCAGTAGTATCTT
TTCCACTACGCTTTACACCGCTTAAAAAGATTAGTTTCATGTGTTTCTCCTCAAATTTAATTAAGATTATAACACACAAAGCTGAAGCATTAAACTT
CTGCTATAATTTTACCATCTTTTTCTACTTGAAAATAGGTGTAAGGAATCGTTGCTGTACATACTAAAGCCGGGTCTGAATCTTCCGTGTAGCTAAA
TTCTACTTCAGATAGGTCAGAAACCCAAGGCTTATAAAAATTTATTGACATCACGATTTCAGTTTTACTATTATCTAAAATGTAAAGCGTAATGTAT
TCAGGACCTGTTTTTTGGGCAGTATTTTCGCCTGTAAGATAGTTACTAGTTCCTAGCATCCATTCATACATTCCTATCCACGACTTAAGCTCTTCGT
CAACTATAAATCTCACGATGAGTGGATCGTACTCAAATGTAACACCTGGACGTTGTGCTCGACCAAGTCCAAACGGCCCAGTCACGGTATCAGTAAC
AGGTATTCTAATTCCTGGAATAGGAACTGACTGAGCATTTAAAGTAAAAGCAGATGTAGTATTACTATGTGGTATTGATACTACAAAGTTAGTTGTA
TTTGCTTGGTTAAAAATTTGTTGCAGTGCTTGCGACATATATTCCTCATAATGCTTTATAAATGTTGGTGGTATAATGGGTCTAAGTCCCTTCCATT
CAATTCCAATTAGAACAAACAATAGAAAAGAATGGAAGATAATAGAATTAGATATTTGACCAGACTTTGTTTGCAGAGAAACGTTTTCCTTTTGAAA
CGAACTGCTGAAGTGGCATTAACACAACGTTCGCCCAGTCTTTCGGGGCGATTTCAACAAGGCTACCCATAATATTACCGGGGATATATGCCTTAAT
CATTTGGTCTGCACCCCTAAATCCTTTCACTTGACTCCAATCAATTTTTAATTTAGTTTTATTAGTAATAGTAGGTGTATTTGAATATTGCTTTAAA
AGCTCTTCTAGAAATTGCTGACGAGCTTTAGGTGGAATATAGTGCAAGTTTAATCCGTACATTAAATTATGTTTACCTAAACCAAGGTAAATTATTA
AAGGAAATTTATCCCAGTAAGGAAGAGTTTCCTTGTGTTTAGCATCATAAGCAAAAGCATATATTCGTCCCGGCTGCGGGCGAACAACTTTATGTCC
TTTTACTTGCTTAATAGTTTCAGCAAACCACTTTCTGGTTTTATTATTAATTGCTGCGCCTTCATTACGAATTTTATCACGCAATGTTTGTCTGAAT
GAATTTATCATAAGCAGTTGTCTTTCTTGCTTATTGAGTTTATTCATTGGTTTTGATTCAAGCTTTTGAATCTTTTCAGCCGTTTTAATTCCTGAAG
CATATTTTGACATTGCCGAAGTAAACGTAGAGTATTTGATTCCTCTTTCTTCAGCAAATTGCTTTCCTGTCATTCCTTTTGCTTTGGCCTTTCTGTA
TTCAAGACCTATCTGAATCCATTTCTTTTCGTTTAATGATTGCTTAACCTTTGGAACTTGGGGAGTGCTTTCATTAATTATTTGAAAAATAGCCATT
ATGCCCCCTTAAAGCCAAGAGCTCGTAATCCATCTTCTGTTAGAATTCTAAATTTTATTCCACGCTTTTCAGCTAAAGATTGTGCTGCTTTCCATTT
GTCGGTATTAACAGAATATGTATAAATTTCATTCATAAATCTTTTCTTCGCTGCGGTTGTTAGATGTGCTGGTTTAACTGGTGGTTGTGTTTCTTTT
TTAGGTTTTATTTCAATAAAAAATTCTTGTCCAGAAGAATCTTTCATCCAAATATCCATGAAGTATCTACGTTTTTTCCCTTCTGCATTACAAAAAT
AAGGAATTACTGCTGTTTCACTACCCCATGCAATAATTTCTGGATTTTTATCTAACCATTCAAAAAAGAATTTTTCCCAATTTGATCTATACGTAAT
TTTTTTAGGGTCACCTCTATACTTTGATATATTTTAGGAACCCATTTTCCAGAATATGCCATTGGATTCTCCTTATAAATAGATAATATATTTATA
AACAGGAGGGCCCATGCTCTTTACATTTTTTGATCCGATTGAATATCGGCAAAATGGAATAAAAACGCGCCGACTATTCCTATGCAGATATT
TTTAGAAACTATAAAGACTATTTTAAACGCGCTCTTGCGGGATACCGCTTACGTACTTATTATATCAAAGGTTCACCACGCCCGGAAGAATTAGCAA
ATACTATATATGGAAATCCGCAGTTGTATTGGGTTTTATTGATGTGTAATGATAATTATGATCCGTATTATGGATGGATTACTTCGCAAGAAGCTGC
TTATCAAGCATCTATACAAAAATACAAAAACGTAGGTGGAGACCAAATAGTATATCATGTGAATGAGAACGGTGAAAAATTTTATAATTTAATATCA
TACGATGATAATCCATATGTTTGGTATGACAAAGGCGATAAAGCTAGAAAATATCCTCAATATGAAGGAGCACTTGCTGCGGTCGATACGTATGAAG
CTGCTGTTCTTGAAAATGAAAAACTTCGTCAAATAAAAATAATAGCAAAATCGGAATAAAAACGCGCGCCGACTTATCGTATAATGGAGAA
ATCTTATGGAAATGATAAGTAATAACCTTAATTGGTTTGTTGGTGTTGTTGAAGATAGAATGGACCCATTAAAATTAGGTCGTGTTCGTGTTCGTGT
AGTTGGTCTGCATCCACCTCAAAGAGCACAAGGCGATGTAATGGGTATTCCAACTGAAAAATTACCATGGATGTCAGTTATTCAACCTATAACTTCT
GCAGCAATGTCTGGAATTGGAGGTTCTGTTACTGGACCGGTAGAAGGAACTAGAGTTTATGGTCATTTTTAGACAAATGGAAAACTAATGGAATTG
TCCTTGGCACGTATGGTGGAATAGTTCGCGAAAAACCGAATAGACTTGAAGGATTTTCTGACCCAACTGGGCAATATCCTAGACGTTTAGGAAATGA
TACTAATGTATTAAACCAAGGCGGAGAAGTAGGATATGATTCGTCTTCTAACATTATCCAAGATAGTAACTTAGCACTGCAATAAATCCGATGAT
AGACCACTATCAGAGATTCCAACCGATGATAATCCAAATATGTCAATGGCTGACATGCTTCGCCGTGATGAAGGATTAAGACTAAAAGTTTATTGGG
ATACTGAAGGATATCCGACAATTGGTATTGGTCATCTTATCATGAAGCAGCCAGTTCGTGATATGGCTCAAATTAATAAAGTTTTATCAAACAAGT
TGGTCGTGAAATTACTGGAAACCCAGGTTCTATTACGATGGAAGAGGCGACGACTTTATTTGAACGTGATTTGGCTGATATGCAACGGGACATTAAA
TCACATTCTAAAGTAGGACCAGTCTGGCAAGCTGTCAACCGTTCTCGTCAAATGGCGTTAGAAAATATGGCATTTCAAATGGGTGTTGGCGGTGTAG
CTAAATTTAACACAATGTTAACTGCTATGTTAGCCGGAGATTGGGAAAAAGCATATAAAGCCGGTCGTGATTCATTGTGGTATCAACAAACAAAAGG
CCGTGCATCCCGTGTTACCATGATTATTCTTACGGGGAATTTGGAATCATATGGTGTTGAAGTGAAAACCCCAGCTAGGTCTCTATCAGCAATGGCT
GCTACTGTAGCTAAATCTTCTGACCCGGCTGACCCTCCTATTCCAAATGACTCGAGAATTTTATTCAAAGAACCAGTTCTTCATATAAAGGTGAAT
ATCCTTATGTGCATACAATGGAAACTGAAAGCGGACATATTCAGGAATTTGATGATACTCCTGGGCAAGAACGATACAGATTAGTTCATCCGACTGG
AACTTATGAAGAAGTATCACCGTCAGGAAGAAGAACAAGAAAAACTGTCGATAATTTGTATGATATAACCAACGCTGATGGTAATTTTTTGGTAGCC
GGTGATAAAAAGACTAACGTCGGTGGATCAGAAATTTATTACAACATGGATAATCGTCTTCACCAAATAGATGGAAGCAATACAATATTTGTACGTG
GCGATGAAACTAAGACAGTTCGAACAACCTAGAACTTCTAAGGTATATGTCACTGGAAAGAAAGCGGTTCAAATGGCTGATCCAATATCAGTTAAAGG
AGATGCTACCACTTTAGTTGAAGGAAATCAAACTAACACAGTAAATGGAAATCTTTCTTGGAAAGTTGCTGGGACAGTTGATTGGGACGTTGGTGGT
GATTGGACAGAAAAAATGGCATCTATGAGTTCTATTTCATCTGGTCAATACACAATTGATGGATCGAGGATTGACATTGGCTAATATACTTCCAATG
AGCGCTGATTTAGGAGAATCCATGGAAGGTTCTTCTATCGACGTCACCTTTACCGCTCAATTAGAAACAGGTGAAACGTTAGTATCTATAAATATAA
CTAGTTACGAAGAAACTCCTGGGGTTTTAGTAGAAGAAAATCGCTTATACGGAACATATGAATCTGTGTTTGGATTTGGAAATGACGCGTTGAAATA
TCGTTTAGGCGATGAATTTAAAACTGCTGCTTCATCGGGAAGAACCTTCCTATGCTTCTGATACTCAGTTGTATTTATGGAAAGCTCCTCAAAACCTC
CAGAAGACATTCACTTACGAAGTAACATTAATATATGACTACCAAGAACAAAGTGAATCTGGAGGTTCTGGCAGTAATTCTAGGTCATCTTCTGATA
CTACTGAACCGACAGATCCTCCTGCTCCAGTAAGAAAAACTCTCGTTAAAAATTTATACTAAAACTATAGTTGGAAATTGGAGTCGTTGGGCTAATAA
ATTAAGAAGCTATGTGTATGAGAGGTCATAGATGTCAGGATTAAGTTATGATAAGTGTGTTACTGCCGGCCATGAAGCATGGCCTCCAACAGTTGTG
AATGCTACACAAAGTAAAGTATTCACTGGAGGAATTGCTGTTCTCGTAGCAGGTGATCCAATTACAGAACATACAGAAATTAAAAAGCCATATGAAA
CACATGCGGAGTGACACAACCTAGAACTTCTAAGGTATATGTCACTGGAAAGAAAGCGGTTCAAATGGCTGATCCAATATCATGCGGTGATACTGT
GGCTCAGGCATCATCTAAAGTATTCATTAAATAGGATTTAAAATGGCAAATACCCCTGTAAATTATCAATTAACAAGAACAGCAAATGCTATTCCCG
AGATATTCGTCGGGGTACATTTGCTGAAATAAAACAAAACCTCATTGAATGGCTTAATGGCCAAAATGAATTTTTGGATTATGATTTTGAAGGCTC
AAGATTAAACGTTCTGTGCGACCCTTTTGGCTTATAATACGCTGTACATTCAACAGTTTGGTAATGCTGCTGTGTATGAAAGCTTTATGCGTACTGCT
AACTTACGAAGTTCAGTTGTTCAAGCTGCACAAGATAACGGATATTTACCTACTTCAAATCCGCTGCGCAGACCGAAATTATGTTAACATGCACCG
ACGCATTGACGAATTACATTACTATTCCTCGCGGAACTCGCTTTTAGCATATGCAAAAGATACTTCTGTTAATCCATATAACTTCGTTTCTAC
CGAAGACGTTATTGCTATTCGTGATAAAAATAACCAATATTTTCCGCGTTTAAAATTGGCCCAGGGACGTATAGTAAGAACTGAAATCATTTATGAT
AAATTAACACCTATTATCATTTATGATAAAAATATTGATAGAAACCAGGTTAAATTATACGTTGATGGAGCAGAATGGATTAACTGGACAAGAAAGT
CAATGGTTCATGCTGGTTCTACATCGACAATTTACTACATGCGTGAAACTATTGATGGAAATACCGAGTTTTATTTGGTGAAGGTGAGATTTCTGT
TAATGCGGCAGAAGGAGCATTGACCGCTAATTATATTGGAGGTCTTAAACCTACTCAGAACTCTACGATTGTTATTGAATACATCAGTACTAACGGT
GCAGATGCGAACGGCGCAGTCGGATTTTCATATGCAGATACATTAACAAATATAACTGTCATCAACATTAATGAAAATCCAAACGATGACCCAGATT
```

Figure 14(S)

```
TTGTTGGGGCAGATGGCGGCGGCGATCCAGAAGATATTGAACGTATTCGCGAATTGGGTACTATTAAACGCGAAACCCAGCAACGCTGCGTAACTGC
GACTGACTATGATACATTCGTTTCAGAGAGATTTGGTTCTATTATTCAAGCAGTTCAGACGTTCACTGATTCTACTAAACCTGGTTATGCATTTATT
GCTGCTAAACCTAAATCAGGACTATATTTAACTACTGTACAGCGCGAAGATATTAAAAATTATCTCAAAGACTATAATTTAGCTCCTATTACGCCAT
CAATTATTTCTCCTAATTACCTTTTTATTAAGACTAATTTAAAAGTCACATATGCTTTAAATAAGCTGCAAGAATCCGAACAGTGGCTCGAAGGTCA
AATAATTGATAAAATTGATCGTTATTATACCGAAGATGTAGAAATTTTTAACTCATCTTTCGCTAAATCTAAGATGTTGACATATGTAGATGATGCA
GATCATTCTATCATTGGCTCATCCGCGACAATTCAAATTGTTCGTGAAGTACAAAACTTCTATAAAACGCCTGAAGCAGGTATTAAATACAATAATC
AAATAAAAGACCGTTCTATGGAATCTAATACGTTTTCATTTAATTCTGGACGAAAGGTTGTAAATCCTGATACTGGTTTAGAAGAAGATGTATTATA
TGACGTTCGCATAGTATCAACAGACCGAAATTCTAAAGGAATTGGTAAAGTTATTATTGGTCCATTTGCTTCTGGCGATGTTACAGAAAATAAAAAC
ATTCGTCCATATACAGGAAACGATTTTAACAAATTAGCAAATTCTGATGGACGCGACAAATACTATGTTATCGGTGAAATAAATTATCCAGCTGATG
TGATTTATTGGAATATCGCTAAAATTAATTTAACATCTGAAAAATTTGAAGTTCAGACCATTGAATTATATTCTGACCCAACCGATGATGTTATCTT
TACTCGCGATGGTTCACTGATTGTATTTGAAAATGACTTACGTCCACAATACTTAACTATCGATTTGGAGCCTATATCACAATGACAGTAAAAGCAC
CTTCAGTCACTAGTCTCAGAATTTCCAAGTTATCCGCAAATCAGGTGCAAGTACGCTGGGATGACGTTGGTGCTAATTTCTACTATTTTGTAGAAAT
CGCTGAGACAAAGACAGACTCGGGGGAAAATCTCCCGAGTAATCAATATAGATGGATTAACTTAGGATATACTGCAAATAACAGCTTCTTTTTTGAC
GATGCTGACCCATTGACATCATACATTATTAGAGTAGCTACAGCTGCACAAGATTTTGAGCAGTCTGATTGGATTTATACCGAAGAGTTTGAAACTT
TTGCTACAAATGCTTATACATTTCAAAACATGATTGAAATGCAATTAGCTAATAAATTCATTCAGGAAAAATTTACTCTTAATAATTCTGACTATGT
TAATTTTAATAATGACACTATAATGGCTGCATTGATGAATGAATCATTCCAATTCAGCCCATCATATGCTGATGTTTCATCAATAAGTAATTTTATT
ATTGGTGAAAATGAGTATCATGAAATACAAGGTTCTATTCAGCAAGTATGTAAGGATATTAATCGAGTTTATTTGATGGAATCAGAAGGGATTCTAT
ATCTTTTTGAGCGTTATCAACCTGTAGTTAAAGTATCCAATGATAAAGGTCAAACCTGGAAAGCTGTAAAGCTCTTCAATGACCGTGTAGGATATCC
TTTATCTAAGACTGTATATTACCAATCTGCGAGCACAACATATGTTCTAGGATACGACAAGATTTTCTATGGCCGCAAATCTACTGATGTTAGATGG
TCAGCTGATGATGTCAGATTTAGTTCGCAGGACATAACATTCGCTAAACTTGGTGATCAACTTCATTTGGGATTTGATGTTGAAATCTTTGGTACTT
ATGCTACATTACCTGCAAACGTGTATCGTATAGCTGAAGCTATTACTTGCACCGATGATTACATTTACGTTGTCGCCAGAGACAAAGTTAGATACAT
AAAAACGAGTAATGCACCTATAGATTCTGATCCATTATCTCCAACATATTCGGAAAGGCTATTTGAACCTGATACAATGACTATAACTGGAAATCCT
AAAGCAGTATGCTATAAAATGGATTCTATTGGTGATAAAGTTTTTGCTCTTATTATCGGTGAAGTTGAAACATTAAATGCTAATCCTAGAACGTCAA
AAATAATTGATTCTACTGATAAAGGAATATATGTTTTAAATCATGACACAAAAACGTGGAAAAGAGTTTTTGGCAACACTGAAGAAGAAAGAAGACG
TATTCAACCTGGGTATGCGAATATGTCAACTGATGGTAAATTAGTTTCTCTATCTTCGAGTAATTTTAAATTTTTAAATGATAACGTTGTTAATGAC
CCTGAAACTGTAGCAAAATATCAGTTAATCGGTGCCGTTAAATATGAATTTCCTCGTGAATGGTTAGCTGATAAGCATTATCATATGATGGCATTTA
TAGCAGATGAAAAGTCTGATTGGGAAACTTTTACGCCTCAGCCAATGAAATACTACGCAGAACCGTTCTTTAATTGGTCTAAAAAATCTAACACACG
CTGTTGGATAAACAACTCTAATAGAGCTGTAGTAGTTTATGCTGATTTAAAATACAC
```

US 10,174,294 B1

RECOMBINANT K2 BACTERIOPHAGES AND USES THEREOF

SEQUENCE LISTING

The instant application contains a Sequence Listing which has been submitted electronically in ASCII format and is hereby incorporated by reference in its entirety. Said ASCII copy, created on Feb. 27, 2018, is named 102590-0609_SL.txt and is 625,157 bytes in size.

TECHNICAL FIELD

The present technology relates generally to compositions including recombinant K2 bacteriophages, methods for making the same, and uses thereof. The recombinant K2 bacteriophages disclosed herein are useful for the identification and/or antibiotic susceptibility profiling of specific bacterial strains/species present in a sample.

BACKGROUND

The following description of the background of the present technology is provided simply as an aid in understanding the present technology and is not admitted to describe or constitute prior art to the present technology.

Bacterial infections may complicate a patient's existing medical condition, and in some cases, may lead to death. Patients suffering from various bacterial infections often present with similar symptoms, thus making it difficult to accurately identify and characterize the bacterial species or strain responsible for the infection. Accurate identification of the bacteria through conventional lab tests can be challenging and may require incubation periods of up to several days. Additionally, some bacterial strains are not amenable to culturing and in vitro analysis in light of their fastidious nature. In other situations, the observable behavior of some bacterial strains is not readily distinguishable from others. Moreover, individual strains of a particular bacterial species may exhibit resistance to otherwise effective antibiotics.

Early and accurate identification of the bacterial strain(s) responsible for a patient's illness and determining its susceptibility to various antibiotics is an important aspect of the treatment selection decision process.

SUMMARY OF THE PRESENT TECHNOLOGY

In one aspect, the present disclosure provides a recombinant K2 bacteriophage nucleic acid sequence, wherein the nucleic acid sequence between (a) position 25,443 and 25,444 of SEQ ID NO: 1 or (b) position 75,922 and 75,923 of SEQ ID NO: 1 is replaced with a heterologous nucleic acid sequence comprising an open reading frame that encodes a reporter protein, wherein the reporter protein is a bioluminescent protein, a fluorescent protein, a chemiluminescent protein, or any combination thereof. In certain embodiments, the open reading frame of the heterologous nucleic acid sequence is operably linked to an expression control sequence that is capable of directing expression of the reporter protein. The expression control sequence may be an inducible promoter or a constitutive promoter. Additionally or alternatively, in some embodiments, the recombinant K2 bacteriophage nucleic acid sequence comprises a sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23, and SEQ ID NO: 24.

Examples of fluorescent protein include, but are not limited to, TagBFP, Azurite, EBFP2, mKalamal, Sirius, Sapphire, T-Sapphire, ECFP, Cerulean, SCFP3A, mTurquoise, monomeric Midoriishi-Cyan, TagCFP, mTFP1, EGFP, Emerald, Superfolder GFP, Monomeric Azami Green, TagGFP2, mUKG, mWasabi, EYFP, Citrine, Venus, SYFP2, TagYFP, Monomeric Kusabira-Orange, mKOK, mKO2, mOrange, mOrange2, mRaspberry, mCherry, dsRed, mStrawberry, mTangerine, tdTomato, TagRFP, TagRFP-T, mApple, mRuby, mPlum, HcRed-Tandem, mKate2, mNeptune, NirFP, TagRFP657, IFP1.4, iRFP, mKeima Red, LSS-mKate1, LSS-mKate2, PA-GFP, PAmCherryl, PATagRFP, Kaede (green), Kaede (red), KikGR1 (green), KikGR1 (red), PS-CFP2, PS-CFP2, mEos2 (green), mEos2 (red), PSmOrange, or Dronpa. Examples of chemiluminescent protein include, but are not limited to, β-galactosidase, horseradish peroxidase (HRP), or alkaline phosphatase. Examples of bioluminescent protein include, but are not limited to, Aequorin, firefly luciferase, *Renilla* luciferase, red luciferase, luxAB, or nanoluciferase. In some embodiments, the bioluminescent protein is nanoluciferase.

In one aspect, the present disclosure provides a vector comprising any of the recombinant K2 bacteriophage nucleic acid sequences disclosed herein, as well as bacterial host cells comprising the vectors of the present technology. The bacterial host cell may be a natural or non-natural host for K2 bacteriophage. In some embodiments, the bacterial host cell expresses K2 capsule genes.

In another aspect, the present disclosure provides a recombinant K2 bacteriophage comprising any of the recombinant K2 bacteriophage nucleic acid sequences of the present technology. Also provided herein are recombinant K2 bacteriophages comprising a nucleic acid sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23 and SEQ ID NO: 24. In some embodiments, the recombinant K2 bacteriophage specifically infects *E. coli* strains that express K2 capsule genes. In some embodiments, the *E. coli* strain that expresses K2 capsule genes is CFT073 (Buckles et al., *J Infect Dis.* 199(11): 10 (2009).

In one aspect, the present disclosure provides a bacterial host cell comprising a recombinant K2 bacteriophage disclosed herein. The bacterial host cell may be a natural or non-natural host for K2 bacteriophage. In some embodiments, the bacterial host cell expresses K2 capsule genes.

In one aspect, the present disclosure provides a method for identifying at least one bacterial strain or species that expresses K2 capsule genes in a test sample obtained from a subject comprising (a) infecting the test sample comprising bacterial cells with a recombinant K2 bacteriophage of the present technology; and (b) detecting the expression of the reporter protein of the recombinant K2 bacteriophage, wherein detection of the reporter protein indicates the presence of at least one bacterial strain or species that expresses K2 capsule genes in the test sample. In some embodiments of the method, the expression of the reporter protein is measured in about 5, 10, 15, 20, 25, 30, 35, 40, 45, 50, 55, 60, 65, 70, 75, 80, 85, 90, or 120 minutes after infecting the test sample comprising bacterial cells with the recombinant K2 bacteriophage.

In another aspect, the present disclosure provides a method for determining the antibiotic susceptibility of a bacterial strain or species in a test sample obtained from a subject comprising (a) infecting a plurality of test samples comprising bacterial cells with a recombinant K2 bacteriophage of the present technology and an antibiotic, wherein the plurality of test samples is derived from the subject; (b) detecting the expression of the reporter protein of the recombinant K2 bacteriophage in the plurality of test samples; and (c) determining that the antibiotic is effective in inhibiting the bacterial strain or species in a test sample when the reporter protein expression levels of the recombinant K2 phage infected bacterial cells in the test sample are reduced relative to that observed in an untreated control sample comprising bacterial cells, wherein the untreated control sample is derived from the subject and is infected with the recombinant K2 phage of the present technology. In some embodiments, the bacterial strain or species in the test sample expresses K2 capsule genes. The expression of the reporter protein may be measured in about 5, 10, 15, 20, 25, 30, 35, 40, 45, 50, 55, 60, 65, 70, 75, 80, 85, 90, or 120 minutes after infecting the plurality of test samples comprising bacterial cells with the recombinant K2 bacteriophage.

Additionally or alternatively, in some embodiments of the methods disclosed herein, the test sample is blood, sputum, mucus, lavage, saliva, or a swab obtained from the subject. In some embodiments, the subject is human.

In certain embodiments of the method, the antibiotic is selected from the group consisting of rifampicin, tetracycline, ampicillin, penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

In one aspect, the present disclosure provides methods for making a recombinant K2 bacteriophage of the present technology in a bacterial host cell. In some embodiments, the method comprises (a) contacting a first K2 bacteriophage genome with a first sgRNA-CRISPR enzyme complex and a second sgRNA-CRISPR enzyme complex in vivo under conditions where (i) the first sgRNA-CRISPR enzyme complex cleaves a first protospacer sequence 5' CCATAGT-CATAACCACCACC 3' (SEQ ID NO: 9) within the first K2 bacteriophage genome; and (ii) the second sgRNA-CRISPR enzyme complex cleaves a second protospacer sequence 5' ACACCAAACAGAATATCAGA 3' (SEQ ID NO: 10) within the first K2 bacteriophage genome to produce a cleaved first K2 bacteriophage genome; and (b) recombining in vivo the cleaved first K2 bacteriophage genome with a heterologous nucleic acid sequence in the presence of a recombination system under conditions to produce the recombinant K2 bacteriophage genome, wherein the bacterial host cell is infected with the first K2 bacteriophage genome, and wherein the heterologous nucleic acid sequence comprises an open reading frame that encodes a bioluminescent protein, a fluorescent protein, a chemiluminescent protein, or any combination thereof. In some embodiments, the first sgRNA-CRISPR enzyme complex comprises Cas9 and a first sgRNA having the sequence of (SEQ ID NO: 11)
5' CCAUAGUCAUAACCACCACCGUUUUAGAGCUAGAAAUAGCAAGUUAA

AAUAAGGCUAGUCCGUUAUCAACUUGAAAAAGUGGCACCGAGUCGGUGCU

UUUUUU 3'.

Additionally or alternatively, in certain embodiments, the second sgRNA-CRISPR enzyme complex comprises Cas9 and a second sgRNA having the sequence of (SEQ ID NO: 12)
5' ACACCAAACAGAAUAUCAGAGUUUUAGAGCUAGAAAUAGCAAGUUAA

AAUAAGGCUAGUCCGUUAUCAACUUGAAAAAGUGGCACCGAGUCGGUGCU

UUUUUU 3'.

The recombination system may be endogenous or non-endogenous. The first K2 bacteriophage genome may be recombinant or non-recombinant.

In other embodiments, the method comprises (a) contacting a first K2 bacteriophage genome with a first sgRNA-CRISPR enzyme complex and a second sgRNA-CRISPR enzyme complex in vivo under conditions where (i) the first sgRNA-CRISPR enzyme complex cleaves a first protospacer sequence 5' ATGCTTGGTTAATCAATTAA 3' (SEQ ID NO: 13) within the first K2 bacteriophage genome; and (ii) the second sgRNA-CRISPR enzyme complex cleaves a second protospacer sequence 5' GACTTTGGTCAAATAC-CGAT 3' (SEQ ID NO: 14) within the first K2 bacteriophage genome to produce a cleaved first K2 bacteriophage genome; and (b) recombining in vivo the cleaved first K2 bacteriophage genome with a heterologous nucleic acid sequence in the presence of a recombination system under conditions to produce the recombinant K2 bacteriophage genome, wherein the bacterial host cell is infected with the first K2 bacteriophage genome, and wherein the heterologous nucleic acid sequence comprises an open reading frame that encodes a bioluminescent protein, a fluorescent protein, a chemiluminescent protein, or any combination thereof. In some embodiments, the first sgRNA-CRISPR enzyme complex comprises Cas9 and a first sgRNA having the sequence of (SEQ ID NO: 15)
5' AUGCUUGGUUAAUCAAUUAAGUUUUAGAGCUAGAAAUAGCAAGUUAA

AAUAAGGCUAGUCCGUUAUCAACUUGAAAAAGUGGCACCGAGUCGGUGCU

UUUUUU 3'.

Additionally or alternatively, in certain embodiments, the second sgRNA-CRISPR enzyme complex comprises Cas9 and a second sgRNA having the sequence of (SEQ ID NO: 16)
5' GACUUUGGUCAAAUACCGAUGUUUUAGAGCUAGAAAUAGCAAGUUAA AAUAAGGCUAGUCCGUUAUCAACUUGAAAAAGUGGCACCGAGUCGGUGCU UUUUUU 3'.

The recombination system may be endogenous or non-endogenous. The first K2 bacteriophage genome may be recombinant or non-recombinant.

Additionally or alternatively, in some embodiments of the methods disclosed herein, the cleaved first K2 bacteriophage genome comprises a first cleaved bacteriophage genomic fragment and a second cleaved bacteriophage genomic fragment. In certain embodiments of the methods disclosed herein, the heterologous nucleic acid sequence comprises a 5' flanking region that is homologous to the 3' end of the first cleaved bacteriophage genomic fragment, and a 3' flanking region that is homologous to the 5' end of the second cleaved bacteriophage genomic fragment.

Additionally or alternatively, in some embodiments of the methods disclosed herein, the recombination system is a non-endogenous recombination system that is induced in the bacterial host cell. The non-endogenous recombination system may comprise lambda Red proteins Gam, Exo, and Beta operably linked to an inducible promoter. In some embodiments of the methods disclosed herein, the inducible promoter is araB and the non-endogenous recombination system is induced by the addition of arabinose.

Additionally or alternatively, in some embodiments of the methods disclosed herein, the bacterial host cell comprises a non-endogenous CRISPR expression vector comprising a nucleic acid sequence that encodes a first sgRNA, a second sgRNA, and a CRISPR enzyme. In some embodiments, the first sgRNA and the second sgRNA are operably linked to a constitutive promoter. In certain embodiments, the CRISPR enzyme is a Cas protein selected from the group consisting of Cas1, Cas1B, Cas2, Cas3, Cas4, Cas5, Cash, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4. The CRISPR enzyme may be operably linked to an inducible promoter, such as a tetracycline-inducible promoter.

In another aspect, the present disclosure provides sgRNAs that are useful for making the recombinant K2 bacteriophages disclosed herein. In some embodiments, the sgRNA sequence is selected from the group consisting of SEQ ID NO: 11, SEQ ID NO: 12, SEQ ID NO: 15 and SEQ ID NO: 16.

Also disclosed herein are kits comprising one or more coded/labeled vials that contain the recombinant K2 bacteriophage of the present technology, instructions for use, and optionally at least one antibiotic.

BRIEF DESCRIPTION OF THE DRAWINGS

FIG. 6(B) discloses the protein sequence as SEQ ID NO: 27.

FIG. 6(C) also discloses SEQ ID NO: 28.

FIG. 6(D) shows the downstream junction sequence of the nanoluciferase insertion in the recombinant K2 phage genome cleaved by sgRNAs B1 and B2: 5' ATAATGTAAT-TCAATTTACGCCAGAATGC 3' (SEQ ID NO: 8).

FIG. 9 shows the heterologous nucleic acid sequence that was inserted into K2 phage genomic DNA that was cleaved between position 25,443 and 25,444 of SEQ ID NO: 1 using single guide RNAs (sgRNAs) sgRNA A1 and sgRNA A2 (SEQ ID NO: 2; donor sequence A). The underlined sequences represent the homologous 5' and 3' flanking regions of the heterologous nucleic acid sequence.

FIG. 10 shows the heterologous nucleic acid sequence that was inserted into K2 phage genomic DNA that was cleaved between position 75,922 and position 75,923 of SEQ ID NO: 1 using single guide RNAs (sgRNAs) sgRNA B1 and sgRNA B2 (SEQ ID NO: 3; donor sequence B). The underlined sequences represent the homologous 5' and 3' flanking regions of the heterologous nucleic acid sequence.

FIGS. 11(A)-11(S) show the partial genome sequence (i.e., contig-1) of the recombinant NanoLuc® K2 phage that was cleaved with sgRNA A1, sgRNA A2, sgRNA B1 and sgRNA B2 and recombined with donor sequence A and donor sequence B (SEQ ID NO: 4).

FIGS. 12(A)-12(S) show the partial genome sequence (i.e., contig-1) of the recombinant NanoLuc® K2 phage that was cleaved with sgRNA A1 and sgRNA A2 only and recombined with donor sequence A (SEQ ID NO: 23).

FIGS. 13(A)-13(S) show the partial genome sequence (i.e., contig-1) of the recombinant NanoLuc® K2 phage that was cleaved with sgRNA B1 and sgRNA B2 only and recombined with donor sequence B (SEQ ID NO: 24).

FIGS. 14(A)-14(S) show the partial genome sequence (i.e., contig-1) of non-recombinant K2 phage (SEQ ID NO: 1).

DETAILED DESCRIPTION

Figure 1:
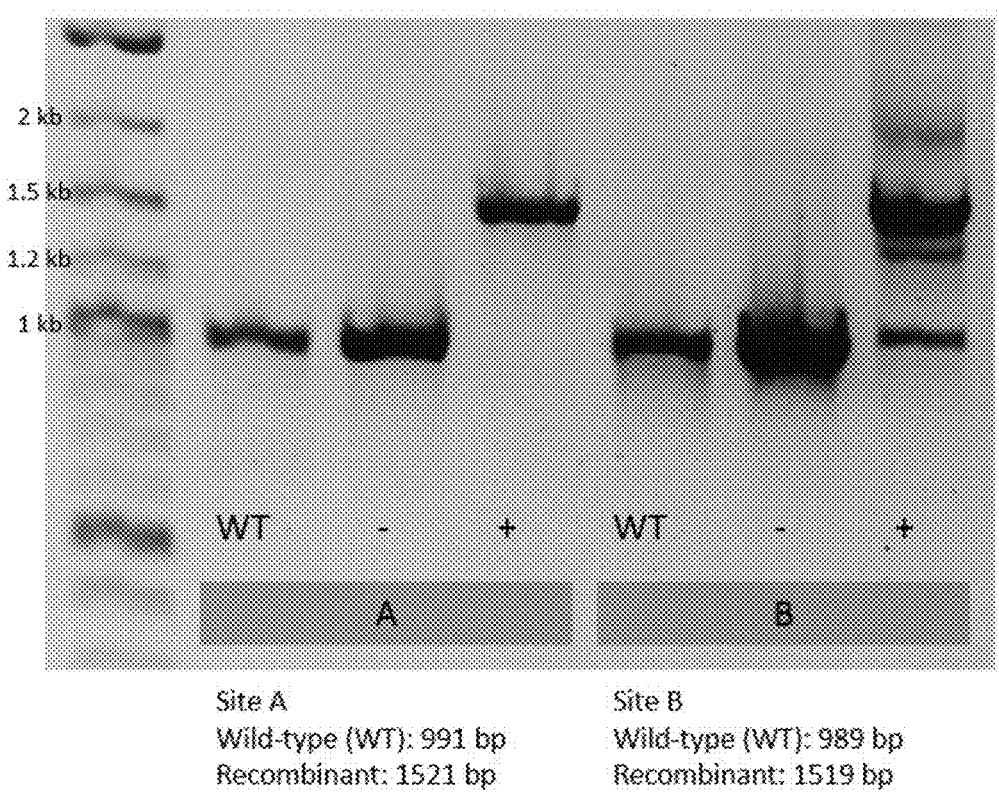
FIG. 1 shows the genotypic analysis of K2 phage infecting an E. coli UPEC strain harboring (A) crP-A (site A cutting plasmid) and pBBR1-K2 A (site A donor plasmid) or (B) crP-B (site B cutting plasmid) and pBBR1-K2 B (site B donor plasmid).

It is to be appreciated that certain aspects, modes, embodiments, variations and features of the present methods are described below in various levels of detail in order to provide a substantial understanding of the present technology.

In practicing the present methods, many conventional techniques in molecular biology, protein biochemistry, cell biology, microbiology and recombinant DNA are used. See, e.g., Sambrook and Russell eds. (2001) *Molecular Cloning: A Laboratory Manual,* 3rd edition; the series Ausubel et al. eds. (2007) *Current Protocols in Molecular Biology*; the series *Methods in Enzymology* (Academic Press, Inc., N.Y.); MacPherson et al. (1991) *PCR 1: A Practical Approach* (IRL Press at Oxford University Press); MacPherson et al. (1995) *PCR 2: A Practical Approach*; Harlow and Lane eds. (1999) *Antibodies, A Laboratory Manual*; Freshney (2005) *Culture of Animal Cells: A Manual of Basic Technique,* 5th edition; Gait ed. (1984) *Oligonucleotide Synthesis*; U.S. Pat. No. 4,683,195; Hames and Higgins eds. (1984) *Nucleic Acid Hybridization*; Anderson (1999) *Nucleic Acid Hybridization*; Hames and Higgins eds. (1984) *Transcription and Translation; Immobilized Cells and Enzymes* (IRL Press (1986)); Perbal (1984) *A Practical Guide to Molecular Cloning*; Miller and Calos eds. (1987) *Gene Transfer Vectors for Mammalian Cells* (Cold Spring Harbor Laboratory); Makrides ed. (2003) *Gene Transfer and Expression in Mammalian Cells*; Mayer and Walker eds. (1987) *Immunochemical Methods in Cell and Molecular Biology* (Academic Press, London); and Herzenberg et al. eds (1996) *Weir's Handbook of Experimental Immunology.*

Definitions

Unless defined otherwise, all technical and scientific terms used herein generally have the same meaning as commonly understood by one of ordinary skill in the art to which this technology belongs. As used in this specification and the appended claims, the singular forms "a", "an" and "the" include plural referents unless the content clearly dictates otherwise. For example, reference to "a cell" includes a combination of two or more cells, and the like. Generally, the nomenclature used herein and the laboratory procedures in cell culture, molecular genetics, organic chemistry, analytical chemistry and nucleic acid chemistry and hybridization described below are those well-known and commonly employed in the art.

As used herein, the term "about" in reference to a number is generally taken to include numbers that fall within a range of 1%, 5%, or 10% in either direction (greater than or less than) of the number unless otherwise stated or otherwise evident from the context (except where such number would be less than 0% or exceed 100% of a possible value).

As used herein, "bacteriophage" or "phage" refers to a virus that infects bacteria. Bacteriophages are obligate intracellular parasites that multiply inside bacteria by co-opting some or all of the host biosynthetic machinery (i.e., viruses that infect bacteria). Though different bacteriophages may contain different materials, they all contain nucleic acid and protein, and can under certain circumstances be encapsulated in a lipid membrane. Depending upon the phage, the nucleic acid can be either DNA or RNA (but not both).

Figure 8A:
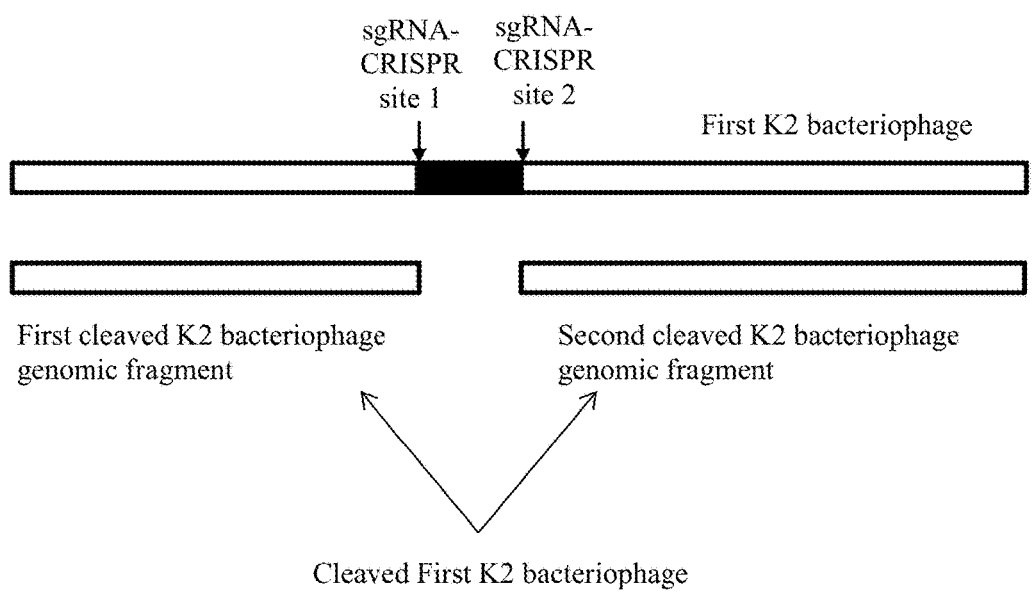
FIG. 8(A) shows a general schematic of a first K2 bacteriophage genome (i.e., intact K2 bacteriophage genome) and a cleaved first K2 bacteriophage genome. The cleaved first K2 bacteriophage genome comprises a first cleaved bacteriophage genomic fragment and a second cleaved bacteriophage genomic fragment.

As used herein, a "cleaved first K2 bacteriophage genome" refers to the K2 bacteriophage genome fragments that are formed after a first K2 bacteriophage genome has undergone enzymatic cleavage with one or two sgRNA-CRISPR enzyme complexes. When a first K2 bacteriophage genome is cleaved with two sgRNA-CRISPR enzyme complexes, the "cleaved first K2 bacteriophage genome" excludes the shortest nucleic acid sequence that lies between the cleavage site of the first sgRNA-CRISPR enzyme complex and the second sgRNA-CRISPR enzyme complex. See FIG. 8(A).

As used herein, a "control" is an alternative sample used in an experiment for comparison purpose. A control can be "positive" or "negative." For example, where the purpose of the experiment is to determine a correlation of the efficacy of a therapeutic agent for the treatment for a particular type of disease or condition, a positive control (a compound or composition known to exhibit the desired therapeutic effect)

and a negative control (a subject or a sample that does not receive the therapy or receives a placebo) are typically employed.

As used herein, "expression" includes one or more of the following: transcription of the gene into precursor mRNA; splicing and other processing of the precursor mRNA to produce mature mRNA; mRNA stability; translation of the mature mRNA into protein (including codon usage and tRNA availability); and glycosylation and/or other modifications of the translation product, if required for proper expression and function.

As used herein, an "expression control sequence" refers to polynucleotide sequences which are necessary to affect the expression of coding sequences to which they are operably linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to encompass, at a minimum, any component whose presence is essential for expression, and can also encompass an additional component whose presence is advantageous, for example, leader sequences.

As used herein, a "heterologous nucleic acid sequence" is any sequence placed at a location in the genome where it does not normally occur. A heterologous nucleic acid sequence may comprise a sequence that does not naturally occur in a bacteriophage, or it may comprise only sequences naturally found in the bacteriophage, but placed at a non-normally occurring location in the genome. In some embodiments, the heterologous nucleic acid sequence is not a natural phage sequence. In certain embodiments, the heterologous nucleic acid sequence is a natural phage sequence that is derived from a different phage. In other embodiments, the heterologous nucleic acid sequence is a sequence that occurs naturally in the genome of a wild-type phage but is then relocated to another site where it does not naturally occur, rendering it a heterologous sequence at that new site.

"Homology" or "identity" or "similarity" refers to sequence similarity between two peptides or between two nucleic acid molecules. Homology can be determined by comparing a position in each sequence which may be aligned for purposes of comparison. When a position in the compared sequence is occupied by the same nucleobase or amino acid, then the molecules are homologous at that position. A degree of homology between sequences is a function of the number of matching or homologous positions shared by the sequences. A polynucleotide or polynucleotide region (or a polypeptide or polypeptide region) has a certain percentage (for example, at least 60%, 65%, 70%, 75%, 80%, 85%, 90%, 95%, 98% or 99%) of "sequence identity" to another sequence means that, when aligned, that percentage of bases (or amino acids) are the same in comparing the two sequences. This alignment and the percent homology or sequence identity can be determined using software programs known in the art. In some embodiments, default parameters are used for alignment. One alignment program is BLAST, using default parameters. In particular, programs are BLASTN and BLASTP, using the following default parameters: Genetic code=standard; filter=none; strand=both; cutoff=60; expect=10; Matrix=BLOSUM62; Descriptions=50 sequences; sort by =HIGH SCORE; Databases=non-redundant, GenBank+EMBL+DDBJ+ PDB+GenBank CDS translations+SwissProtein+SPupdate+ PIR. Details of these programs can be found at the National Center for Biotechnology Information. Biologically equivalent polynucleotides are those having the specified percent homology and encoding a polypeptide having the same or similar biological activity. Two sequences are deemed "unrelated" or "non-homologous" if they share less than 40% identity, or less than 25% identity, with each other.

As used herein, a "host cell" is a bacterial cell that can be infected by a phage to yield progeny phage particles. A host cell can form phage particles from a particular type of phage genomic DNA. In some embodiments, the phage genomic DNA is introduced into the host cell by infecting the host cell with a phage. In some embodiments, the phage genomic DNA is introduced into the host cell using transformation, electroporation, or any other suitable technique. In some embodiments, the phage genomic DNA is substantially pure when introduced into the host cell. In some embodiments, the phage genomic DNA is present in a vector when introduced into the host cell. The definition of host cell can vary from one phage to another. For example, E. coli may be the natural host cell for a particular type of phage, but Klebsiella pneumoniae is not.

As used herein, the term "isolated" refers to a substance or entity that has been separated from at least some of the components with which it was associated when initially produced (whether in nature or in an experimental setting). Isolated substances and/or entities may be separated from at least about 10%, about 20%, about 30%, about 40%, about 50%, about 60%, about 70%, about 80%, about 90%, or more of the other components with which they were initially associated. In some embodiments, isolated substances and/ or entities are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

As used herein, "operably linked" means that expression control sequences are positioned relative to a nucleic acid of interest to initiate, regulate or otherwise control transcription of the nucleic acid of interest.

As used herein, a "phage genome" or "bacteriophage genome" includes naturally occurring phage genomes and derivatives thereof. Generally, the derivatives possess the ability to propagate in the same hosts as the naturally occurring phage. In some embodiments, the only difference between a naturally occurring phage genome and a derivative phage genome is at least one of a deletion or an addition of nucleotides from at least one end of the phage genome (if the genome is linear) or at least one point in the genome (if the genome is circular).

As used herein, the term "polynucleotide" or "nucleic acid" means any RNA or DNA, which may be unmodified or modified RNA or DNA. Polynucleotides include, without limitation, single- and double-stranded DNA, DNA that is a mixture of single- and double-stranded regions, single- and double-stranded RNA, RNA that is mixture of single- and double-stranded regions, and hybrid molecules comprising DNA and RNA that may be single-stranded or, more typically, double-stranded or a mixture of single- and double-stranded regions. In addition, polynucleotide refers to triple-stranded regions comprising RNA or DNA or both RNA and DNA. The term polynucleotide also includes DNAs or RNAs containing one or more modified bases and DNAs or RNAs with backbones modified for stability or for other reasons.

As used herein, the term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the material is derived from a cell so modified. Thus, for example, recombinant cells express genes that are not found within the native (non-recombinant) form of the cell or express native genes that are otherwise abnormally expressed, under expressed or not expressed at all.

As used herein, an endogenous nucleic acid sequence in the genome of an organism (or the encoded protein product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous to the organism (originating from the same organism or progeny thereof) or exogenous (originating from a different organism or progeny thereof). By way of example, a promoter sequence can be substituted (e.g., by homologous recombination) for the native promoter of a gene in the genome of an organism, such that this gene has an altered expression pattern. This gene would be "recombinant" because it is separated from at least some of the sequences that naturally flank it. A nucleic acid is also considered "recombinant" if it contains any modifications that do not naturally occur in the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

As used herein, a "recombinant bacteriophage genome" is a bacteriophage genome that has been genetically modified by the insertion of a heterologous nucleic acid sequence into the bacteriophage genome. A "recombinant bacteriophage" means a bacteriophage that comprises a recombinant bacteriophage genome. In some embodiments, the bacteriophage genome is modified by recombinant DNA technology to introduce a heterologous nucleic acid sequence into the genome at a defined site. In some embodiments, the heterologous nucleic acid sequence is introduced with no corresponding loss of endogenous phage genomic nucleotides. In other words, if bases N1 and N2 are adjacent in the wild-type bacteriophage genome, the heterologous nucleic acid sequence is inserted between N1 and N2. Thus, in the resulting recombinant bacteriophage genome, the heterologous nucleic acid sequence is flanked by nucleotides N1 and N2. In some embodiments, endogenous phage nucleotides are removed or replaced during the insertion of the heterologous nucleic acid sequence. For example, in some embodiments, the heterologous nucleic acid sequence is inserted in place of some or all of the endogenous phage sequence which is removed. In some embodiments, endogenous phage sequences are removed from a position in the phage genome distant from the site(s) of insertion of the heterologous nucleic acid sequences.

As used herein, a "recombinant K2 bacteriophage" or "recombinant K2 phage" means a K2 bacteriophage whose genomic DNA comprises a heterologous nucleic acid sequence that encodes a bioluminescent protein, a fluorescent protein, a chromogenic protein, or any combination thereof.

As used herein, the term "sample" refers to clinical samples obtained from a subject or isolated microorganisms. In certain embodiments, a sample is obtained from a biological source (i.e., a "biological sample"), such as tissue, bodily fluid, or microorganisms collected from a subject. Sample sources include, but are not limited to, mucus, sputum, bronchial alveolar lavage (BAL), bronchial wash (BW), whole blood, bodily fluids, cerebrospinal fluid (CSF), urine, plasma, serum, or tissue.

As used herein, "a sub-sample" refers to one or more samples containing bacterial cells that are derived from a test sample obtained from a subject. In some embodiments, the sub-sample is void of non-bacterial cells (e.g., human cells). In some embodiments, the sub-sample contains lysed human cells.

As used herein, "test sample" refers to a sample taken from a subject that is to be assayed for the presence of bacteria and/or for the antibiotic susceptibility of bacteria present in the sample. In some embodiments, the test sample is blood, sputum, mucus, lavage, or saliva. In certain embodiments, the test sample is a swab from a subject.

As used herein, the terms "subject," "individual," or "patient" are used interchangeably and refer to an individual organism, a vertebrate, a mammal, or a human. In certain embodiments, the individual, patient or subject is a human.

As used herein, a "vector" refers to a nucleic acid molecule capable of transporting another nucleic acid to which it has been linked. One type of vector is a "plasmid," which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

Bacteriophage

Bacteriophage are obligate intracellular parasites that multiply inside bacteria by co-opting some or all of the host biosynthetic machinery. Phages contain nucleic acid and protein, and may be enveloped by a lipid membrane. Depending upon the phage, the nucleic acid genome can be either DNA or RNA but not both, and can exist in either circular or linear forms. The size of the phage genome varies depending upon the phage. The simplest phages have genomes that are only a few thousand nucleotides in size, while the more complex phages may contain more than 100,000 nucleotides in their genome, and in rare instances no more than 500,000 bp. The number and amount of individual types of protein in phage particles will vary depending upon the phage. The proteins function in infection and to protect the nucleic acid genome from environmental nucleases.

Phage genomes come in a variety of sizes and shapes (e.g., linear or circular). Most phages range in size from 24-200 nm in diameter. The capsid is composed of many copies of one or more phage proteins, and acts as a protective envelope around the phage genome. Many phages have tails attached to the phage capsid. The tail is a hollow tube through which the phage nucleic acid passes during infection. The size of the tail can vary and some phages do not even have a tail structure. In the more complex phages, the tail is surrounded by a contractile sheath which contracts during infection of the bacterial host cell. At the end of the tail, phages have a base plate and one or more tail fibers attached to it. The base plate and tail fibers are involved in the binding of the phage to the host cell.

Lytic or virulent phages are phages which can only multiply in bacteria and lyse the bacterial host cell at the end of the life cycle of the phage. The lifecycle of a lytic phage begins with an eclipse period. During the eclipse phase, no infectious phage particles can be found either inside or outside the host cell. The phage nucleic acid takes over the host biosynthetic machinery and phage specific mRNAs and proteins are produced. Early phage mRNAs code for early proteins that are needed for phage DNA synthesis and for shutting off host DNA, RNA and protein biosynthesis. In some cases, the early proteins actually degrade the host chromosome. After phage DNA is made late mRNAs and late proteins are made. The late proteins are the structural proteins that comprise the phage as well as the proteins needed for lysis of the bacterial cell. In the next phase, the phage nucleic acid and structural proteins are assembled and infectious phage particles accumulate within the cell. The bacteria begin to lyse due to the accumulation of the phage lysis protein, leading to the release of intracellular phage particles. The number of particles released per infected cell can be as high as 1000 or more. Lytic phage may be enumerated by a plaque assay. The assay is performed at a low enough concentration of phage such that each plaque arises from a single infectious phage. The infectious particle that gives rise to a plaque is called a PFU (plaque forming unit).

Lysogenic phages are those that can either multiply via the lytic cycle or enter a quiescent state in the host cell. In the quiescent state, the phage genome exists as a prophage (i.e., it has the potential to produce phage). In most cases, the phage DNA actually integrates into the host chromosome and is replicated along with the host chromosome and passed on to the daughter cells. The host cell harboring a prophage is not adversely affected by the presence of the prophage and the lysogenic state may persist indefinitely. The lysogenic state can be terminated upon exposure to adverse conditions. Conditions which favor the termination of the lysogenic state include: desiccation, exposure to UV or ionizing radiation, exposure to mutagenic chemicals, etc. Adverse conditions lead to the production of proteases (rec A protein), the expression of the phage genes, reversal of the integration process, and lytic multiplication.

Recombinant K2 Phage Compositions of the Present Technology

The recombinant K2 bacteriophage of the present technology specifically infects *E. coli* strains that express K2 capsule genes. In some embodiments, the *E. coli* strain that expresses K2 capsule genes is CFT073.

In one aspect, the present disclosure provides a recombinant K2 bacteriophage nucleic acid sequence, wherein the nucleic acid sequence between (a) position 25,443 and 25,444 of SEQ ID NO: 1 or (b) position 75,922 and 75,923 of SEQ ID NO: 1 is replaced with a heterologous nucleic acid sequence comprising an open reading frame that encodes a reporter protein, wherein the reporter protein is a bioluminescent protein, a fluorescent protein, a chemiluminescent protein, or any combination thereof. In some embodiments, the heterologous nucleic acid sequence further comprises at least one segment that corresponds to at least part of the excised endogenous phage genome sequence between (a) position 25,443 and 25,444 of SEQ ID NO: 1 or (b) position 75,922 and 75,923 of SEQ ID NO: 1.

The present disclosure also provides a recombinant K2 bacteriophage nucleic acid sequence, wherein the nucleic acid sequence between (a) position 24,610 and 24,611 of SEQ ID NO: 1, (b) position 26,130 and 26,131 0f SEQ ID NO: 1, (c) position 75,590 and 75,591 of SEQ ID NO: 1 or (d) position 76,394 and 76,395 is replaced with a heterologous nucleic acid sequence comprising an open reading frame that encodes a reporter protein, wherein the reporter protein is a bioluminescent protein, a fluorescent protein, a chemiluminescent protein, or any combination thereof.

Also disclosed herein are recombinant K2 bacteriophages that comprise any recombinant K2 bacteriophage nucleic acid sequence disclosed herein. In some embodiments, the reporter protein(s) encoded by the heterologous nucleic acid sequence produces a detectable signal upon exposure to the appropriate stimuli, and the resulting signal permits detection of bacterial host cells infected by a recombinant K2 phage of the present technology.

In certain embodiments, the open reading frame encodes a reporter protein that serves as a marker that can be identified by screening bacterial host cells infected by a recombinant K2 phage of the present technology. Examples of such markers include by way of example and without limitation: a fluorescent label, a luminescent label, a chemiluminescence label, or an enzymatic label. In some embodiments, the heterologous nucleic acid sequence further comprises sequences naturally found in the bacteriophage, but placed at a non-normally occurring location in the genome.

In some embodiments, the length of the heterologous nucleic acid sequence is at least 100 bases, at least 200 bases, at least 300 bases, at least 400 bases, at least 500 bases, at least 600 bases, at least 700 bases, at least 800 bases, at least 900 bases, at least 1 kilobase (kb), at least 1.1 kb, at least 1.2 kb, at least 1.3 kb, at least 1.4 kb, at least 1.5 kb, at least 1.6 kb, at least 1.7 kb, at least 1.8 kb, at least 1.9 kb, at least 2.0 kb, at least 2.1 kb, at least 2.2 kb, at least 2.3 kb, at least 2.4 kb, at least 2.5 kb, at least 2.6 kb, at least 2.7 kb, at least 2.8 kb, at least 2.9 kb, at least 3.0 kb, at least 3.1 kb, at least 3.2 kb, at least 3.3 kb, at least 3.4 kb, at least 3.5 kb, at least 3.6 kb, at least 3.7 kb, at least 3.8 kb, at least 3.9 kb, at least 4.0 kb, at least 4.5 kb, at least 5.0 kb, at least 5.5 kb, at least 6.0 kb, at least 6.5 kb, at least 7.0 kb, at least 7.5 kb, at least 8.0 kb, at least 8.5 kb, at least 9.0 kb, at least 9.5 kb, at least 10 kb, or more. In certain embodiments, the heterologous nucleic acid sequence comprises a length that is less than or equal to a length selected from the group consisting of 1 kb, 2 kb, 3 kb, 4 kb, 5 kb, 6 kb, 7 kb, 8 kb, 9 kb, and 10 kb. In some embodiments, the heterologous nucleic acid sequence comprises a length that is less than or equal to the maximum length of heterologous nucleic acid sequence that can be packaged into a phage particle comprising the phage genome.

In some embodiments, the length of the heterologous nucleic acid sequence is from 100 to 500 bases, from 200 to 1,000 bases, from 500 to 1,000 bases, from 500 to 1,500 bases, from 1 kb to 2 kb, from 1.5 kb to 2.5 kb, from 2.0 kb to 3.0 kb, from 2.5 kb to 3.5 kb, from 3.0 kb to 4.0 kb, from 3.5 kb to 4.5 kb, from 4.0 kb to 5.0 kb, from 4.5 kb to 5.5 kb, from 5.0 kb to 6.0 kb, from 5.5 kb to 6.5 kb, from 6.0 kb to 7.0 kb, from 6.5 kb to 7.5 kb, from 7.0 kb to 8.0 kb, from 7.5 kb to 8.5 kb, from 8.0 kb to 9.0 kb, from 8.5 kb to 9.5 kb, or from 9.0 kb to 10.0 kb.

In some embodiments, the heterologous nucleic acid sequence is inserted into the K2 phage genome with no loss of endogenous K2 phage genomic sequence. In some embodiments, the heterologous nucleic acid sequence replaces an endogenous K2 phage genomic sequence. In some embodiments, the heterologous nucleic acid sequence includes an endogenous K2 phage genomic sequence that was previously excised from the phage genome.

In certain embodiments, the heterologous nucleic acid sequence replaces an endogenous K2 phage genomic sequence that is less than the length of the heterologous nucleic acid sequence. Accordingly, in some embodiments, the length of the recombinant K2 phage genome is longer than the length of the wild-type K2 phage genome. In some embodiments, the heterologous nucleic acid sequence replaces an endogenous K2 phage genomic sequence that is greater than the length of the heterologous nucleic acid sequence. Thus, in some embodiments, the length of the recombinant K2 phage genome is shorter than the length of the wild-type K2 phage genome. In certain embodiments, the heterologous nucleic acid sequence replaces an endogenous K2 phage genomic sequence that is equal to the length of the heterologous nucleic acid sequence.

In certain embodiments, the open reading frame of the heterologous nucleic acid sequence encodes a reporter protein that confers a phenotype of interest on a host cell infected by a recombinant K2 phage of the present technology. In some embodiments, the phenotype of interest is the expression of the gene product encoded by the open reading frame of the heterologous nucleic acid sequence.

In certain embodiments, the open reading frame of the heterologous nucleic acid sequence is operably linked to an expression control sequence that is capable of directing expression of the open reading frame, wherein the open reading frame encodes a reporter protein (e.g., a bioluminescent protein, a fluorescent protein, a chemiluminescent protein, or any combination thereof). In some embodiments, the expression control sequence is located within the heterologous nucleic acid sequence. In other embodiments, the expression control sequence is located in the endogenous K2 phage genome sequence. For example, the open reading frame may be inserted into the K2 phage genome downstream of or in the place of an endogenous K2 phage open reading frame sequence. In some embodiments, the expression control sequence is an inducible promoter or a constitutive promoter (e.g., sarA promoter or 1pp promoter). See e.g., Djordjevic & Klaenhammer, *Methods in Cell Science* 20(1): 119-126 (1998). The inducible promoter or constitutive promoter may be an endogenous K2 phage promoter sequence, a phage promoter sequence that is non-endogenous to K2 phage, or a bacterial host promoter sequence. Additionally or alternatively, in some embodiments, the inducible promoter is a pH-sensitive promoter, or a temperature sensitive promoter.

In some embodiments, the heterologous nucleic acid sequence comprises a first open reading frame and at least one supplemental open reading frame. In certain embodiments, the first and the at least one supplemental open reading frames are operably linked to the same expression control sequences. In some embodiments, the first and the at least one supplemental open reading frames are operably linked to different expression control sequences.

Fluorescent proteins include, but are not limited to, blue/UV fluorescent proteins (for example, TagBFP, Azurite, EBFP2, mKalamal, Sirius, Sapphire, and T-Sapphire), cyan fluorescent proteins (for example, ECFP, Cerulean, SCFP3A, mTurquoise, monomeric Midoriishi-Cyan, TagCFP, and mTFP1), green fluorescent proteins (for example, EGFP, Emerald, Superfolder GFP, Monomeric Azami Green, TagGFP2, mUKG, and mWasabi), yellow fluorescent proteins (for example, EYFP, Citrine, Venus, SYFP2, and TagYFP), orange fluorescent proteins (for example, Monomeric Kusabira-Orange, mKOK, mKO2, mOrange, and mOrange2), red fluorescent proteins (for example, mRaspberry, mCherry, dsRed, mStrawberry, mTangerine, tdTomato, TagRFP, TagRFP-T, mApple, and mRuby), far-red fluorescent proteins (for example, mPlum, HcRed-Tandem, mKate2, mNeptune, and NirFP), near-IR fluorescent proteins (for example, TagRFP657, IFP1.4, and iRFP), long stokes-shift proteins (for example, mKeima Red, LS S-mKate1, and LSS-mKate2), photoactivatable fluorescent proteins (for example, PA-GFP, PAmCherry1, and PATagRFP), photoconvertible fluorescent proteins (for example, Kaede (green), Kaede (red), KikGR1 (green), KikGR1 (red), PS-CFP2, PS-CFP2, mEos2 (green), mEos2 (red), PSmOrange, and PSmOrange), fluorescein, rhodamine, and photoswitchable fluorescent proteins (for example, Dronpa).

Examples of bioluminescent proteins are aequorin (derived from the jellyfish *Aequorea victoria*) and luciferases (including luciferases derived from firefly and *Renilla*, nanoluciferase, red luciferase, luxAB, and the like). These proteins have also been genetically separated into two distinct functional domains that will generate light only when the protein domains are closely co-localized. A variety of emission spectrum-shifted mutant derivatives of both of these proteins have been generated over the past decade and have been used for multi-color imaging and co-localization within a living cell.

Examples of chemiluminescent protein include β-galactosidase, horseradish peroxidase (HRP), and alkaline phosphatase. Peroxidases generate peroxide that oxidizes luminol in a reaction that generates light, whereas alkaline phosphatases remove a phosphate from a substrate molecule, destabilizing it and initiating a cascade that results in the emission of light.

In some embodiments, the open reading frame of the heterologous nucleic acid sequence comprises an epitope that can be detected with an antibody or other binding molecule. For example, an antibody that recognizes the epitope may be directly linked to a signal generating moiety (such as by covalent attachment of a chemiluminescent or fluorescent protein), or can be detected using at least one additional binding reagent such as a secondary antibody, directly linked to a signal generating moiety. In some embodiments, the epitope is absent in wild-type K2 bacteriophage and the bacterial host cell. Accordingly, detection of the epitope in a sample demonstrates the presence of a bacterial host cell infected by a recombinant K2 phage comprising a heterologous nucleic acid sequence, wherein the open reading frame of the heterologous nucleic acid sequence comprises the epitope. In other embodiments, the open reading frame of the heterologous nucleic acid sequence comprises a polypeptide tag sequence, such that the expression product of the open reading frame comprises the tag fused to a polypeptide or protein encoded by the open reading frame (e.g., poly-histidine, FLAG, Glutathione S-transferase (GST) etc.).

In some embodiments, the open reading frame of the heterologous nucleic acid sequence comprises a biotin binding protein such as avidin, streptavidin, or neutrAvidin that can be detected with a biotin molecule conjugated to an enzyme (e.g., β-galactosidase, horseradish peroxidase (HRP), and alkaline phosphatase) or an antibody. In some embodiments, an antibody conjugated to a biotin molecule may be directly linked to a signal generating moiety (such as by covalent attachment of a chemiluminescent or fluorescent protein), or can be detected using at least one additional binding reagent such as a secondary antibody, directly linked to a signal generating moiety.

Also disclosed herein are recombinant K2 bacteriophages comprising any of the recombinant K2 bacteriophage nucleic acid sequences disclosed herein. In some embodiments, the recombinant K2 bacteriophages comprise a nucleic acid sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23 and SEQ ID NO: 24.

In another aspect, the present disclosure provides a vector comprising any of the recombinant K2 bacteriophage nucleic acid sequences disclosed herein, as well as bacterial host cells comprising the vectors of the present technology. In some embodiments, the bacterial host cell expresses K2 capsule genes. The bacterial host cell may be a natural or non-natural host for K2 bacteriophage.

The present disclosure also provides a bacterial host cell comprising a recombinant K2 bacteriophage disclosed herein. In some embodiments, the bacterial host cell expresses K2 capsule genes. The bacterial host cell may be a natural or non-natural host for K2 bacteriophage.

Methods of Making Recombinant K2 Bacteriophage of the Present Technology

In one aspect, the present disclosure provides methods for making a recombinant K2 bacteriophage of the present technology in a bacterial host cell. The bacterial host cell may be a non-natural bacterial host cell or a natural bacterial host cell for K2 bacteriophage.

In some embodiments, the method comprises (a) contacting a first K2 bacteriophage genome with a first sgRNA-CRISPR enzyme complex and a second sgRNA-CRISPR enzyme complex in vivo under conditions where (i) the first sgRNA-CRISPR enzyme complex cleaves a first protospacer sequence 5'CCATAGTCATAACCACCACC 3' (SEQ ID NO: 9) within the first K2 bacteriophage genome; and (ii) the second sgRNA-CRISPR enzyme complex cleaves a second protospacer sequence 5' ACACCAAACAGAATATCAGA 3' (SEQ ID NO: 10) within the first K2 bacteriophage genome to produce a cleaved first K2 bacteriophage genome; and (b) recombining in vivo the cleaved first K2 bacteriophage genome with a heterologous nucleic acid sequence in the presence of a recombination system under conditions to produce the recombinant K2 bacteriophage genome, wherein the bacterial host cell is infected with the first K2 bacteriophage genome, and wherein the heterologous nucleic acid sequence comprises an open reading frame that encodes a bioluminescent protein, a fluorescent protein, a chemiluminescent protein, or any combination thereof. In some embodiments, the first sgRNA-CRISPR enzyme complex comprises Cas9 and a first sgRNA having the sequence of (SEQ ID NO: 11)
5' CCAUAGUCAUAACCACCACCGUUUUAGAGCUAGAAAUAGCAAGUUAA

AAUAAGGCUAGUCCGUUAUCAACUUGAAAAAGUGGCACCGAGUCGGUGCU

UUUUUU 3'.

Additionally or alternatively, in certain embodiments, the second sgRNA-CRISPR enzyme complex comprises Cas9 and a second sgRNA having the sequence of (SEQ ID NO: 12)
5' ACACCAAACAGAAUAUCAGAGUUUUAGAGCUAGAAAUAGCAAGUUAA

AAUAAGGCUAGUCCGUUAUCAACUUGAAAAAGUGGCACCGAGUCGGUGCU

UUUUUU 3'.

The recombination system may be endogenous or non-endogenous. The first K2 bacteriophage genome may be recombinant or non-recombinant.

In other embodiments, the method comprises (a) contacting a first K2 bacteriophage genome with a first sgRNA-CRISPR enzyme complex and a second sgRNA-CRISPR enzyme complex in vivo under conditions where (i) the first sgRNA-CRISPR enzyme complex cleaves a first protospacer sequence 5' ATGCTTGGTTAATCAATTAA 3' (SEQ ID NO: 13) within the first K2 bacteriophage genome; and (ii) the second sgRNA-CRISPR enzyme complex cleaves a second protospacer sequence 5' GACTTTGGTCAAATAC-CGAT 3' (SEQ ID NO: 14) within the first K2 bacteriophage genome to produce a cleaved first K2 bacteriophage genome; and (b) recombining in vivo the cleaved first K2 bacteriophage genome with a heterologous nucleic acid sequence in the presence of a recombination system under conditions to produce the recombinant K2 bacteriophage genome, wherein the bacterial host cell is infected with the first K2 bacteriophage genome, and wherein the heterologous nucleic acid sequence comprises an open reading frame that encodes a bioluminescent protein, a fluorescent protein, a chemiluminescent protein, or any combination thereof. In some embodiments, the first sgRNA-CRISPR enzyme complex comprises Cas9 and a first sgRNA having the sequence of (SEQ ID NO: 15)
5' AUGCUUGGUUAAUCAAUUAAGUUUUAGAGCUAGAAAUAGCAAGUUAA

AAUAAGGCUAGUCCGUUAUCAACUUGAAAAAGUGGCACCGAGUCGGUGCU

UUUUUU 3'.

Additionally or alternatively, in certain embodiments, the second sgRNA-CRISPR enzyme complex comprises Cas9 and a second sgRNA having the sequence of (SEQ ID NO: 16)
5' GACUUUGGUCAAAUACCGAUGUUUUAGAGCUAGAAAUAGCAAGUUAA

AAUAAGGCUAGUCCGUUAUCAACUUGAAAAAGUGGCACCGAGUCGGUGCU

UUUUUU 3'.

The recombination system may be endogenous or non-endogenous. The first K2 bacteriophage genome may be recombinant or non-recombinant.

The cleaved first K2 bacteriophage genome comprises a first cleaved bacteriophage genomic fragment and a second cleaved bacteriophage genomic fragment. In certain embodiments of the methods disclosed herein, the heterologous nucleic acid sequence comprises a 5' flanking region that is homologous to the 3' end of the first cleaved bacteriophage genomic fragment, and a 3' flanking region that is homologous to the 5' end of the second cleaved bacteriophage genomic fragment.

In some embodiments of the methods disclosed herein, the homologous 5' flanking region of the heterologous nucleic acid sequence has a length of about 20-30 base pairs (bps), 30-40 bps, 40-50 bps, 50-60 bps, 60-70 bps, 70-80 bps, 80-90 bps, 90-100 bps, 100-110 bps, 110-120 bps, 120-130 bps, 130-140 bps, 140-150 bps, 150-160 bps, 160-170 bps, 170-180 bps, 180-190 bps, 190-200 bps, 200-210 bps, 210-220 bps, 220-230 bps, 230-240 bps, 240-250 bps, 250-260 bps, 260-270 bps, 270-280 bps, 280-290 bps, 290-300 bps, 300-310 bps, 310-320 bps, 320-330 bps, 330-340 bps, 340-350 bps, 350-360 bps, 360-370 bps, 370-380 bps, 380-390 bps, 390-400 bps, 400-410 bps, 410-420 bps, 420-430 bps, 430-440 bps, 440-450 bps, 450-460 bps, 460-470 bps, 470-480 bps, 480-490 bps, 490-500 bps, 500-510 bps, 510-520 bps, 520-530 bps, 530-540 bps, 540-550 bps, 550-560 bps, 560-570 bps, 570-580 bps, 580-590 bps, or 590-600 bps.

Additionally or alternatively, in some embodiments of the methods disclosed herein, the homologous 3' flanking region of the heterologous nucleic acid sequence has a length of about 20-30 base pairs (bps), 30-40 bps, 40-50 bps, 50-60 bps, 60-70 bps, 70-80 bps, 80-90 bps, 90-100 bps, 100-110 bps, 110-120 bps, 120-130 bps, 130-140 bps, 140-150 bps, 150-160 bps, 160-170 bps, 170-180 bps, 180-190 bps, 190-200 bps, 200-210 bps, 210-220 bps, 220-230 bps, 230-240 bps, 240-250 bps, 250-260 bps, 260-270 bps, 270-280 bps, 280-290 bps, 290-300 bps, 300-310 bps, 310-320 bps, 320-330 bps, 330-340 bps, 340-350 bps, 350-360 bps, 360-370 bps, 370-380 bps, 380-390 bps, 390-400 bps, 400-410 bps, 410-420 bps, 420-430 bps, 430-440 bps, 440-450 bps, 450-460 bps, 460-470 bps, 470-480 bps, 480-490 bps, 490-500 bps, 500-510 bps, 510-520 bps, 520-530 bps, 530-540 bps, 540-550 bps, 550-560 bps, 560-570 bps, 570-580 bps, 580-590 bps, or 590-600 bps.

Additionally or alternatively, in some embodiments of the methods disclosed herein, the recombination system is a non-endogenous recombination system that is induced in the bacterial host cell. The non-endogenous recombination system may include a recombination expression vector that comprises lambda Red proteins Gam, Exo, and Beta operably linked to an inducible promoter. In some embodiments of the methods disclosed herein, the inducible promoter is araB and the non-endogenous recombination system is induced by the addition of arabinose. In some embodiments, the recombination expression vector further comprises the heterologous nucleic acid sequence. In other embodiments, the expression vector comprising the heterologous nucleic acid sequence is separate and distinct from the recombination expression vector comprising lambda Red proteins.

In other embodiments of the methods disclosed herein, the recombination system is a non-endogenous recombination system that includes a recombination expression vector comprising RecET (RecE, RecT) operons operably linked to an inducible promoter, and optionally the heterologous nucleic acid sequence. In some embodiments, the inducible promoter is araB and the non-endogenous recombination system is induced by the addition of arabinose. In other embodiments, the expression vector comprising the heterologous nucleic acid sequence is separate and distinct from the recombination expression vector comprising RecET.

In another embodiment of the methods disclosed herein, the recombination system is a non-endogenous recombination system that includes a recombination expression vector comprising RecA recombinase or a RecA gain-of-function variant operably linked to an inducible promoter and optionally the heterologous nucleic acid sequence. In some embodiments, the inducible promoter is araB and the non-endogenous recombination system is induced by the addition of arabinose. In other embodiments, the expression vector comprising the heterologous nucleic acid sequence is separate and distinct from the recombination expression vector comprising RecA recombinase or the RecA gain-of-function variant.

Additionally or alternatively, in some embodiments of the methods disclosed herein, the bacterial host cell comprises a non-endogenous CRISPR expression vector comprising a nucleic acid sequence that encodes a first sgRNA, a second sgRNA, and a CRISPR enzyme. In some embodiments, the first sgRNA and the second sgRNA are operably linked to a constitutive promoter. In some embodiments, the sequence of the first sgRNA and the second sgRNA is SEQ ID NO: 11 and SEQ ID NO: 12, respectively. In other embodiments, the sequence of the first sgRNA and the second sgRNA is SEQ ID NO: 15 and SEQ ID NO: 16, respectively.

A variety of CRISPR enzymes are available for use in conjunction with the disclosed methods of the present disclosure. In some embodiments, the CRISPR enzyme is a Type II CRISPR enzyme. In some embodiments, the CRISPR enzyme catalyzes DNA cleavage. In some embodiments, the CRISPR enzyme catalyzes RNA cleavage. In some embodiments, the CRISPR enzyme is any Cas9 protein, for instance any naturally-occurring bacterial Cas9 as well as any variants, homologs or orthologs thereof. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or variants thereof. The CRISPR enzyme may be operably linked to an inducible promoter, such as a tetracycline-inducible promoter. In some embodiments, the CRISPR enzyme cleaves both strands of the target nucleic acid at the Protospacer Adjacent Motif (PAM) site.

In another aspect, the present disclosure provides sgRNAs that are useful for making the recombinant K2 bacteriophages disclosed herein. In some embodiments, the sgRNA sequence is selected from the group consisting of SEQ ID NO: 11, SEQ ID NO: 12, SEQ ID NO: 15 and SEQ ID NO: 16. The design of sgRNAs that are capable of cleaving at the other K2 genomic positions described herein, is within the scope of one of ordinary skill in the art.

Bacterial Identification and Antibiotic Susceptibility Profiling Methods of the Present Technology Accurate identification of bacterial species within a biological sample informs the selection of suitable therapies for treating bacterial infections. The recombinant K2 bacteriophages disclosed herein may be used to identify bacteria present within a biological sample (e.g., whole blood, plasma, serum). Such methods entail contacting the biological sample with a recombinant K2 bacteriophage disclosed herein, and detecting the presence of bacterial host cells infected by the recombinant K2 phage, wherein the recombinant K2 phage comprises a heterologous nucleic acid sequence that encodes a detectable gene product, thereby leading to the identification of bacteria present within the biological sample.

Additionally or alternatively, the recombinant K2 bacteriophages disclosed herein, may be used in methods for profiling antibiotic susceptibility of bacteria present within a biological sample (e.g., whole blood, plasma, serum). These methods include (a) infecting the biological sample with an antibiotic and a recombinant K2 bacteriophage disclosed herein, (b) detecting the presence of bacterial host cells infected by the recombinant K2 phage, wherein the recombinant K2 phage comprises a heterologous nucleic acid sequence that encodes a detectable gene product, and (c) determining that the antibiotic is effective in inhibiting the bacteria present in the biological sample when the levels of recombinant K2 phage infected bacterial host cells is reduced relative to that observed in an untreated control sample.

In one aspect, the present disclosure provides a method for identifying at least one bacterial strain or species in a test sample obtained from a subject comprising (a) separating bacterial cells isolated from the test sample into one or more sub-samples, (b) infecting each sub-sample with at least one recombinant K2 bacteriophage disclosed herein, wherein each recombinant K2 bacteriophage comprises a heterologous nucleic acid sequence encoding one or more reporter genes, and (c) identifying at least one bacterial strain or species in the test sample by detecting the expression of the one or more reporter genes of the at least one recombinant K2 bacteriophage. In certain embodiments, the at least one K2 bacteriophage comprises a nucleic acid sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23 and SEQ ID NO: 24. In certain embodiments, the method for identifying at least one bacterial strain or species in a test sample does not require the culturing of bacterial cells from the test sample or a sub-sample.

In some embodiments, identification of at least one bacterial strain or species includes detecting the expression of the one or more reporter genes of the at least one recombinant K2 bacteriophage, e.g., detectable expression of green fluorescence indicates the presence of bacterial species A in a test sample or sub-sample. In some embodiments, the absence of at least one bacterial strain or species is identified by the lack of detectable expression of the one or more reporter genes of the at least one recombinant K2 bacteriophage, e.g., undetectable expression of green fluorescence indicates the lack of bacterial species A in a test sample or sub-sample.

In some embodiments, the at least one recombinant K2 bacteriophage infects a single species of bacteria. In certain embodiments, the at least one recombinant K2 bacteriophage infects two or more species of bacteria. By way of example, but not by way of limitation, in some embodiments, the species of bacteria that are infected include *E. coli* strains that express K2 capsule genes. In some embodiments, the *E. coli* strain that expresses K2 capsule genes is CFT073.

In some embodiments, detection of the expression of the reporter gene is detection of the gene product itself, e.g., a fluorescent protein. In some embodiments, detection of the expression of the reporter gene is detection of an enzymatic reaction requiring the expression of the reporter gene, e.g., expression of luciferase to catalyze luciferin to produce light.

In some embodiments, the expression of the one or more reporter genes is detected in about 5, 10, 15, 20, 25, 30, 35, 40, 45, 50, 55, 60, 65, 70, 75, 80, 85, 90, 120 minutes or any time between any two of the preceding values after infecting a sub-sample with the at least one recombinant K2 bacteriophage disclosed herein.

The present disclosure also provides a method for identifying at least one bacterial strain or species that expresses K2 capsule genes in a test sample obtained from a subject comprising (a) infecting the test sample comprising bacterial cells with a recombinant K2 bacteriophage of the present technology; and (b) detecting the expression of the reporter protein of the recombinant K2 bacteriophage, wherein detection of the reporter protein indicates the presence of at least one bacterial strain or species that expresses K2 capsule genes in the test sample. In some embodiments of the method, the expression of the reporter protein is measured in about 5, 10, 15, 20, 25, 30, 35, 40, 45, 50, 55, 60, 65, 70, 75, 80, 85, 90 or 120 minutes after infecting the test sample comprising bacterial cells with the recombinant K2 bacteriophage.

Additionally or alternatively, in some embodiments of the methods disclosed herein, the test sample is blood, sputum, mucus, lavage, saliva, or a swab obtained from the subject. In some embodiments, the subject is human.

In another aspect, the present disclosure provides a method for determining the antibiotic susceptibility of a bacterial strain or species in a test sample obtained from a subject comprising (a) separating bacterial cells isolated from the test sample into a plurality of sub-samples, (b) infecting the plurality of sub-samples with a recombinant K2 bacteriophage disclosed herein and at least one antibiotic, wherein the recombinant K2 bacteriophage comprises a heterologous nucleic acid sequence encoding a reporter gene, and (c) detecting the expression of the reporter gene of the recombinant K2 bacteriophage in the presence of each antibiotic. In some embodiments, the method further comprises determining that the bacterial strain or species in the test sample is susceptible to an antibiotic if the reporter gene expression of the recombinant K2 bacteriophage in the antibiotic treated sub-sample is decreased relative to that observed in a control sub-sample that is not treated with the antibiotic. In other embodiments, the method further comprises determining that the bacterial strain or species in the test sample is resistant to an antibiotic if the reporter gene expression of the recombinant K2 bacteriophage in the antibiotic treated sub-sample is comparable to that observed in a control sub-sample that is not treated with the antibiotic. In certain embodiments, the method for determining the antibiotic susceptibility of a bacterial strain or species in a test sample does not require the culturing of bacterial cells from a test sample or a sub-sample.

Additionally or alternatively, in some embodiments of the recombinant K2 bacteriophages of the present technology, the reporter gene is nanoluciferase. In certain embodiments, recombinant K2 bacteriophage comprises a nucleic acid sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23 and SEQ ID NO: 24.

Examples of antibiotics include one or more of rifampicin, tetracycline, ampicillin, penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

In some embodiments of the method, the differences in the reporter gene expression of the recombinant K2 bacteriophage observed in the antibiotic treated sub-sample and the untreated control sub-sample is defined as µ.

Additionally or alternatively, in some embodiments of the method, the expression of the reporter gene is detected in about 5, 10, 15, 20, 25, 30, 35, 40, 45, 50, 55, 60, 65, 70, 75, 80, 85, 90, 120 minutes or any time between any two of the preceding values after infecting a sub-sample with a recombinant K2 bacteriophage disclosed herein.

In some embodiments, two or more sub-samples are tested for antibiotic susceptibility in series. In some embodiments, two or more sub-samples are tested for antibiotic susceptibility in parallel. In some embodiments, one or more sub-samples are tested for antibiotic susceptibility in a running assay (where resistance or sensitivity to one antibiotic is determined and the resistance or sensitivity to a second, third, fourth, fifth, etc., antibiotic is being assayed).

In some embodiments of the methods disclosed herein, isolating bacterial cells from a test sample includes incubating the test sample with distilled water to form a mixture, centrifuging the mixture to form a pellet that includes bacterial cells, and re-suspending the pellet to form a bacterial suspension comprising isolated bacterial cells after discarding the supernatant. The pellet may be re-suspended in a phosphate buffer. In some embodiments, the bacterial suspension is divided into one or more sub-samples.

In certain embodiments of the methods disclosed herein, mixing the test sample with distilled water will lead to the lysis of cells that lack cell walls (e.g., mammalian cells and red blood cells) while leaving cells with cell walls (e.g., bacteria) intact. Without wishing to be bound by theory, in some embodiments, the removal of cells that lack cell walls enhances the detection of reporter gene expression in bacterial cells infected with a recombinant K2 bacteriophage, as intact non-bacterial cells (e.g., red blood cells) may quench reporter gene expression. In some embodiments of the methods of the present technology, the mixture is about 90% distilled water and 10% test sample, about 80% distilled water and 20% test sample, about 70% distilled water and 30% test sample, about 60% distilled water and 40% test sample, about 50% distilled water and 50% test sample, about 40% distilled water and 60% test sample, about 30% distilled water and 70% test sample, about 20% distilled water and 80% sample, or about 10% distilled water and 90% test sample. In some embodiments of the methods disclosed herein, the mixture is incubated for 1, 2, 3, 4, 5, 6, 7, 8, 9, 10, 11, 12, 13, 14, or 15 minutes, or any time between two of the previously listed time points. Additionally or alternatively, in certain embodiments of the methods disclosed herein, the mixture is centrifuged for 1, 2, 3, 4, 5, 6, 7, 8, 9, 10, 11, 12, 13, 14, or 15 minutes, or any time between two of the previously listed time points.

Additionally or alternatively, in certain embodiments of the methods disclosed herein, each of the one or more sub-samples comprise between about 5 to 500, about 10 to 400, about 20 to 300, about 30 to 300, about 40 to 200 or about 50 to 100 bacterial cells. In some embodiments of the methods disclosed herein, each of the one or more sub-samples comprises between about 100 to 10,000, about 200 to 9,000, about 300 to 8,000, about 400 to 7,000, about 500 to 6,000, about 600 to 5,000, about 700 to 4,000, about 800 to 3,000, about 900 to 2,000, or about 1,000 to 1,500 bacterial cells.

In another aspect, the present disclosure provides a method for determining the antibiotic susceptibility of a bacterial strain or species in a test sample obtained from a subject comprising (a) infecting a plurality of test samples comprising bacterial cells with a recombinant K2 bacteriophage of the present technology and an antibiotic, wherein the plurality of test samples is derived from the subject; (b) detecting the expression of the reporter protein of the recombinant K2 bacteriophage in the plurality of test samples; and (c) determining that the antibiotic is effective in inhibiting the bacterial strain or species in a test sample when the reporter protein expression levels of the recombinant K2 phage infected bacterial cells in the test sample are reduced relative to that observed in an untreated control sample comprising bacterial cells, wherein the untreated control sample is derived from the subject and is infected with the recombinant K2 phage of the present technology. In some embodiments, the bacterial strain or species in the test sample expresses K2 capsule genes. The expression of the reporter protein may be measured in about 5, 10, 15, 20, 25, 30, 35, 40, 45, 50, 55, 60, 65, 70, 75, 80, 85, 90, or 120 minutes after infecting the plurality of test samples comprising bacterial cells with the recombinant K2 bacteriophage. In other embodiments, the method further comprises determining that the bacterial strain or species in the test sample is resistant to the antibiotic when the reporter protein expression levels of the recombinant K2 bacteriophage infected bacterial cells in the test sample are comparable to that observed in an untreated control sample comprising bacterial cells, wherein the untreated control sample is derived from the subject and is infected with recombinant K2 phage of the present technology.

In any of the above embodiments of the methods of the present technology, the test sample is blood, sputum, mucus, lavage, saliva, or a swab obtained from the subject. In some embodiments of the methods disclosed herein, the test sample is obtained from a mammalian subject, including, for example, farm animals, such as sheep, pigs, cows, and horses; pet animals, such as dogs and cats; and laboratory animals, such as rats, mice and rabbits. In one embodiment, the mammal subject is a human.

Kits

The present technology provides kits including the recombinant K2 bacteriophages disclosed herein for bacteria identification and antibiotic susceptibility profiling.

In one aspect, the kits of the present technology comprise one or more coded/labeled vials that contain a plurality of the recombinant K2 bacteriophages disclosed herein, and instructions for use. In some embodiments, each coded/labeled vial corresponds to a different recombinant K2 bacteriophage. In other embodiments, each coded/labeled vial corresponds to the same recombinant K2 bacteriophage. In some embodiments, the kits of the present technology comprise one or more coded/labeled vials that contain at least one recombinant K2 bacteriophage comprising a nucleic acid sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23 and SEQ ID NO: 24.

In some embodiments, each phage vial is assigned a unique code that identifies the bacteriophage in the phage vial, or the types of bacteria that the bacteriophage strain infects. The unique code can be encoded by a machine discernible pattern, such as a bar code, a QR code, an alphanumeric string, or any other pattern that can be discerned by a reader. Each unique code may be shown as, for example, a bar code sticker on a vial or container storing a corresponding phage sample. In some embodiments, the kit is stored under conditions that permit the preservation of the bacteriophage genomes for extended periods, such as under bacteriophage-specific, controlled temperature, moisture, and pH conditions.

Additionally or alternatively, in some embodiments, the kits further comprise vials containing natural or non-natural bacterial host cells. In some embodiments, the bacterial host cells are *E. coli*. In certain embodiments, the bacterial host cells are *E. coli* strain UPEC.

The kits may also comprise instructions for use, software for automated analysis, containers, packages such as packaging intended for commercial sale and the like.

The kit may further comprise one or more of: wash buffers and/or reagents, hybridization buffers and/or reagents, labeling buffers and/or reagents, and detection means. The buffers and/or reagents are usually optimized for the particular detection technique for which the kit is intended. Protocols for using these buffers and reagents for performing different steps of the procedure may also be included in the kit. Further optional components of the kits may include expression media for gene products encoded by the heterologous nucleic acids of the recombinant K2 bacteriophages disclosed herein, such as a medium containing nutrients and cofactors for bioluminescence, devices such as a lamp configured to illuminate at specific wavelengths of light to detect biofluorescence, and devices for measuring the extent of heterologous nucleic acid expression, such as a photometer or photodetector.

Additionally or alternatively, the kits disclosed herein may also include coded and labeled vials that contain a plurality of antibiotics. In some embodiments, the plurality of antibiotics comprises one or more of rifampicin, tetracycline, levofloxacin, and ampicillin. Other examples of antibiotics include penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

Additionally or alternatively, in some embodiments, the kits comprise one or more sgRNA sequences selected from the group consisting of SEQ ID NO: 11, SEQ ID NO: 12, SEQ ID NO: 15 and SEQ ID NO: 16.

EXAMPLES

Example 1: Design and Methods for Generating the Recombinant K2 Bacteriophages of the Present Technology This Example demonstrates that the methods of the present technology are useful for making the recombinant K2 bacteriophages disclosed herein in a bacterial host cell.

Figure 8B:
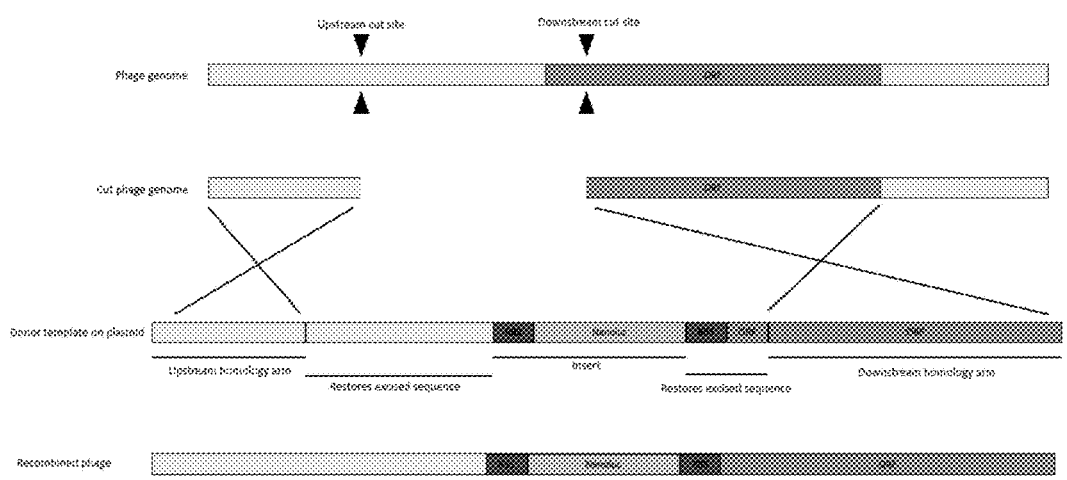
FIG. 8(B) shows a general schematic of the donor template design and recombination between a cleaved phage genome and the donor template. Two double-stranded breaks are generated by Cas9 at sites specified by the two sgRNAs. In some instances, Cas9 cleavage excises a phage DNA sequence that is important for phage viability. The donor template contains any exogenous reporter gene inserts like nanoluciferase, but must also restore the function of excised phage sequences. The 5' and 3' flanking regions of the donor template are homologous to the DNA sequences immediately adjacent to the two cleavage sites in the phage genome, and are necessary for repairing double-stranded breaks via homologous recombination.
Figure 15A:
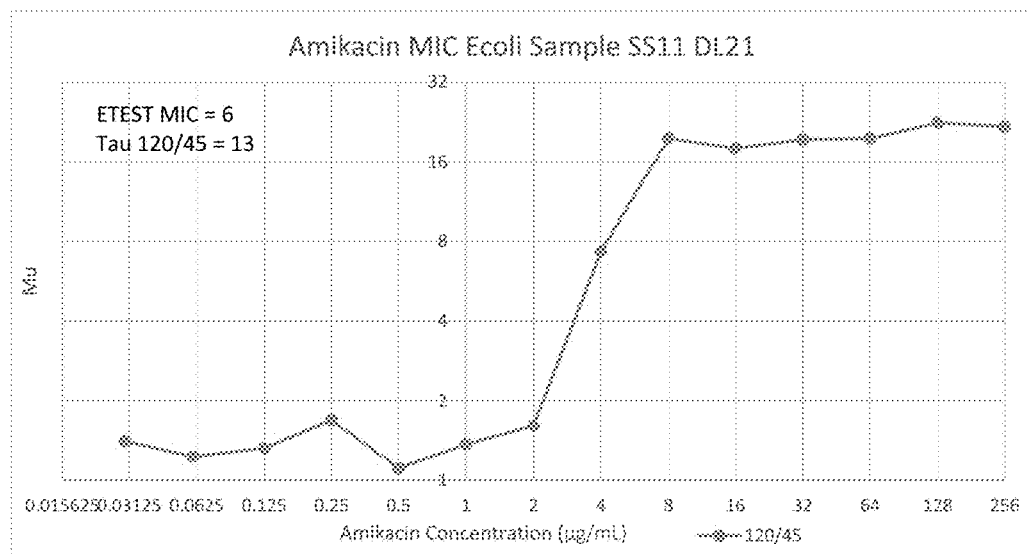
FIG. 15(A) shows the antibiotic susceptibility profile of an *E. coli* strain to amikacin using the recombinant K2 phages of the present technology.
Figure 15B:
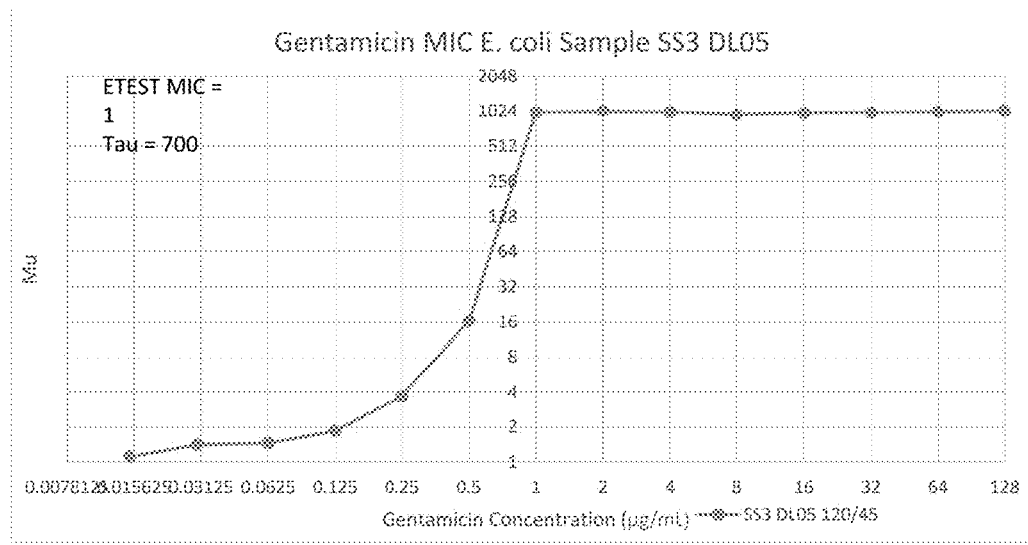
FIG. 15(B) shows the antibiotic susceptibility profile of an *E. coli* strain to gentamicin using the recombinant K2 phages of the present technology.
Figure 15C:
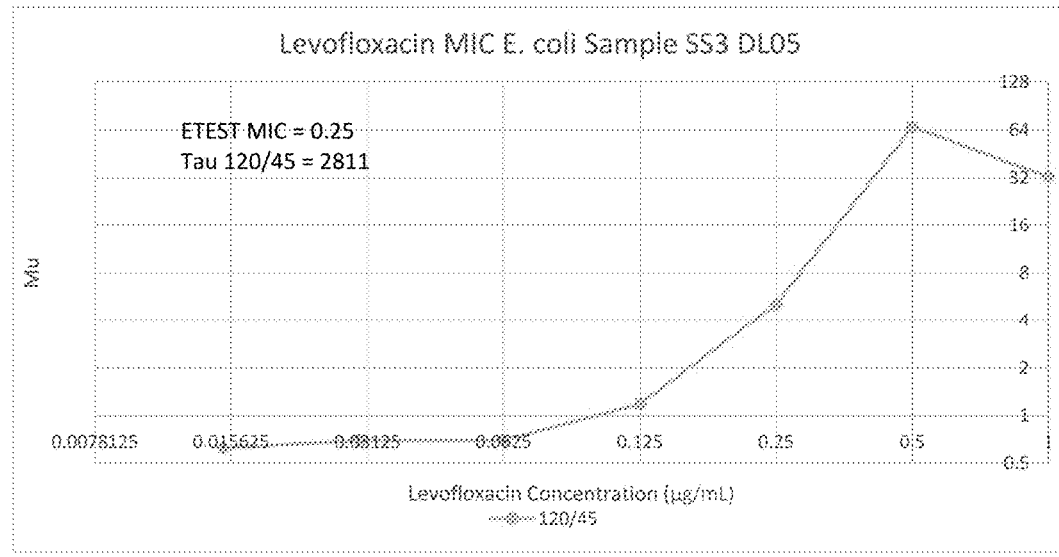
FIG. 15(C) shows the antibiotic susceptibility profile of an *E. coli* strain to levofloxacin using the recombinant K2 phages of the present technology.
Figure 15D:
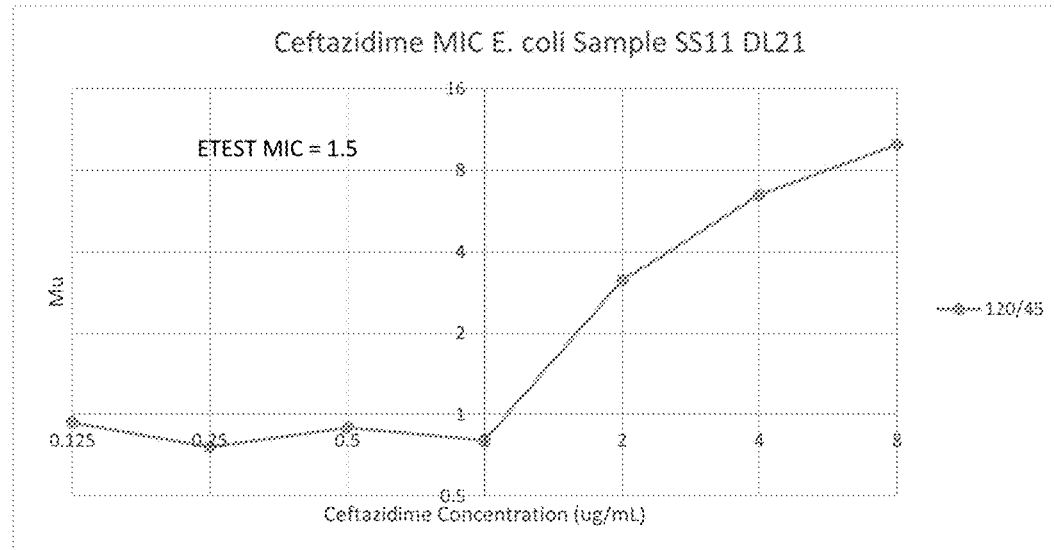
FIG. 15(D) shows the antibiotic susceptibility profile of an *E. coli* strain to ceftazidime using the recombinant K2 phages of the present technology.

The recombinant *E. coli* K2 bacteriophage of the present technology were engineered using a 'break and recombine' (BAR) phage engineering method. The BAR method relies on (1) cleaving a phage genome in vivo at one or two locations using an RNA-guided endonuclease (e.g., Cas9)-sgRNA complex, and (2) providing a heterologous nucleic acid sequence comprising the nanoluciferase gene with an upstream ribosome binding site as well as 5' and 3' flanking regions that are homologous to a portion of the initial K2 phage genome (collectively, referred to as the donor template region). The donor template region also contains sequences that restore the function of any K2 phage DNA that was excised by the sgRNA-CRISPR enzyme complexes. The 5' and 3' flanking regions (about several hundred base pairs in length) are homologous to the DNA sequences immediately adjacent to the two cleavage sites in the phage genome (FIGS. 8(A)-8(B)), and are necessary for repairing double-stranded breaks via homologous recombination.

Figure 14G:
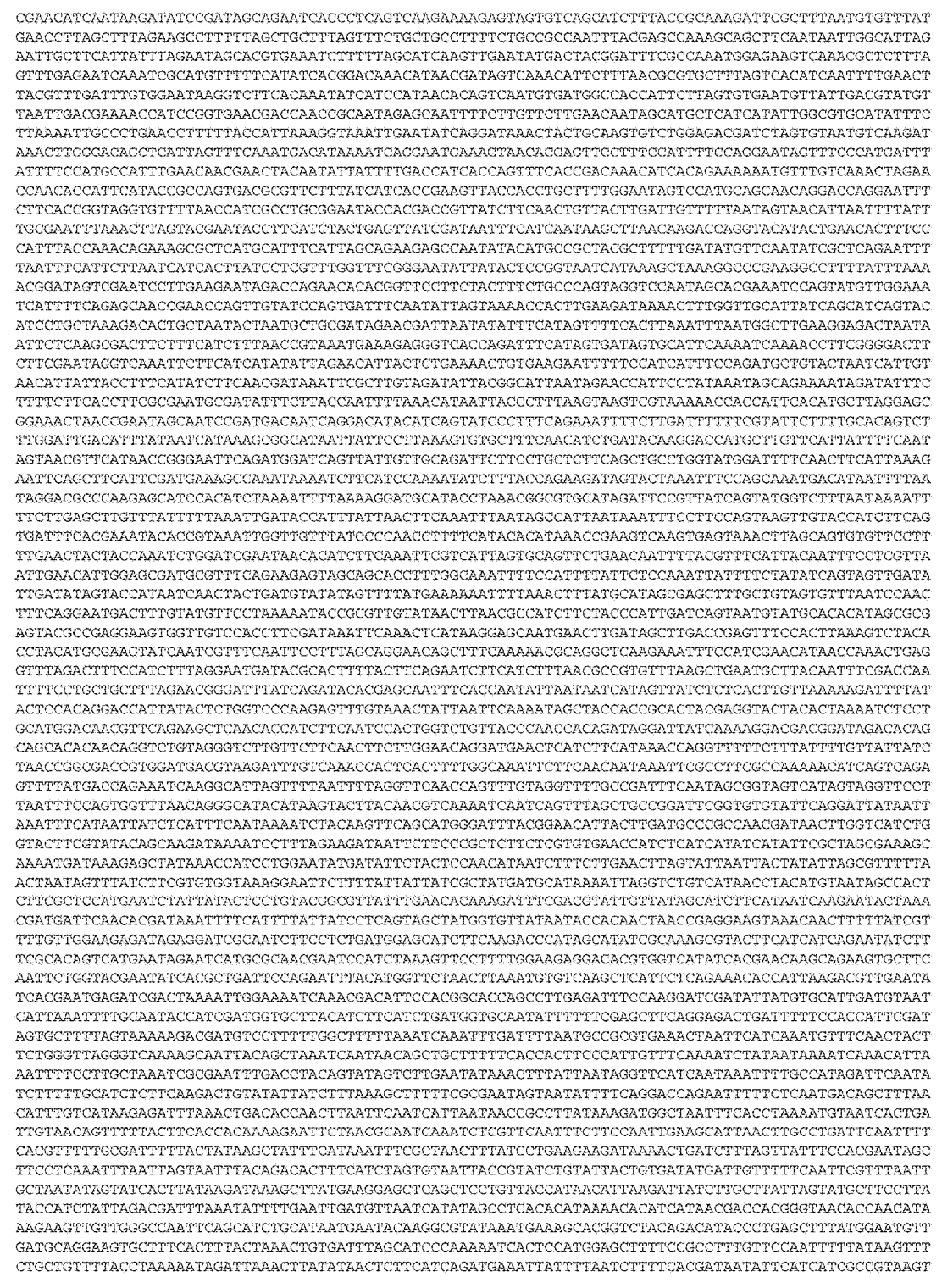
Figure 14H:
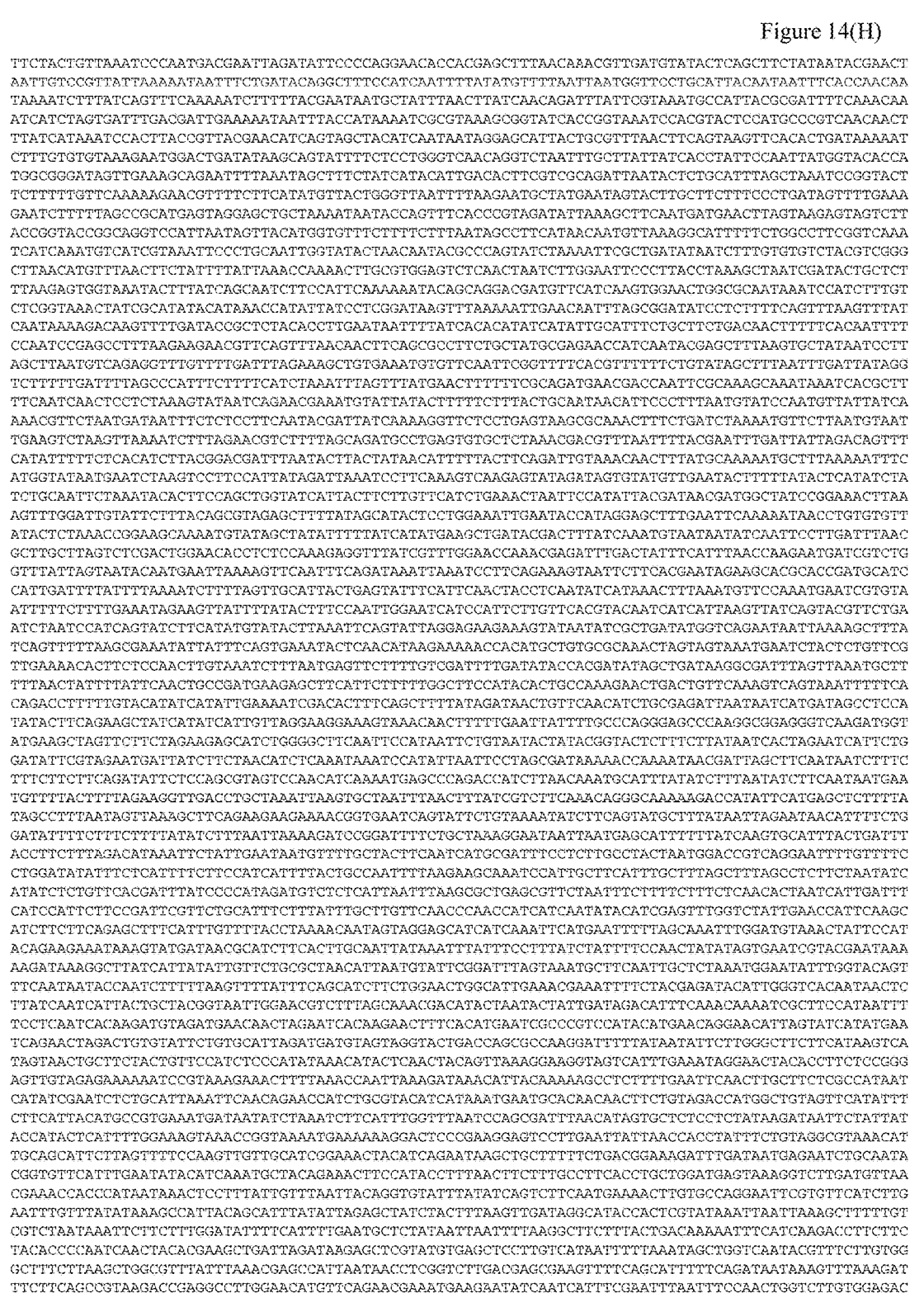
Figure 14O:
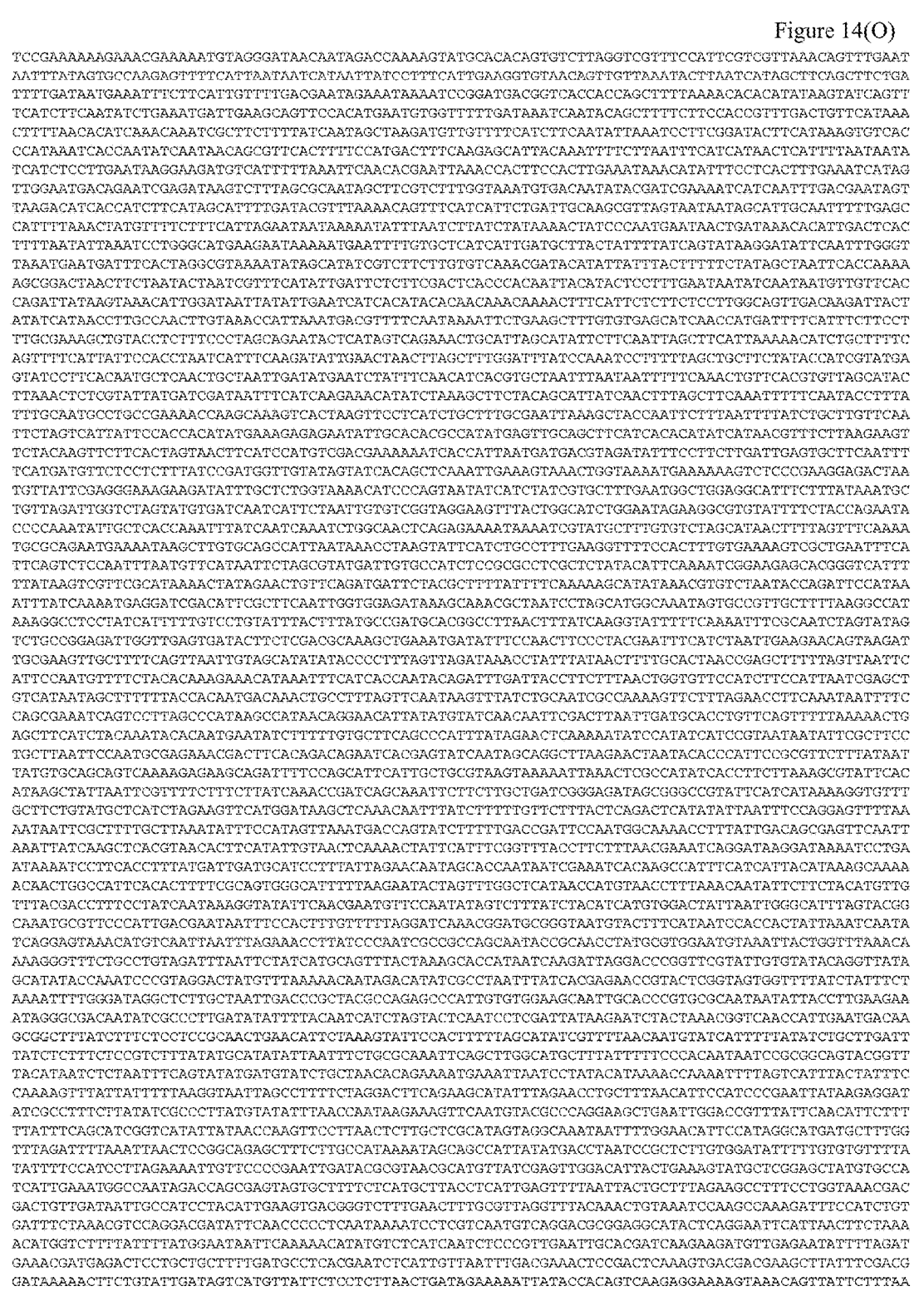

Two insertion sites (site A' and 'site B') were selected for inserting the nanoluciferase reporter gene into a portion of the initial K2 phage genome (i.e., K2 contig-1). The sequence of the initial K2 contig-1 region is shown in FIGS. 14(A)-14(S) and is represented by SEQ ID NO: 1. 20 bp protospacer sites, along with the accompanying 3 bp protospacer adjacent motif (PAM) were identified near 'site A' and 'site B.' The K2 protospacer sequences along with their adjacent PAM sites (PAM site underlined) are provided below:

```
Protospacer A1    5' CCATAGTCATAACCACC/ACCCGG 3'
                  (SEQ ID NO: 17)

Protospacer A2    5' ACACCAAACAGAATATC/AGAGGG 3'
                  (SEQ ID NO: 18)

Protospacer B1    5' ATGCTTGGTTAATCAAT/TAAGGG 3'
                  (SEQ ID NO: 19)

Protospacer B2    5' GACTTTGGTCAAATACC/GATGGG 3'
                  (SEQ ID NO: 20)
```
cleavage sites marked with a '/'

The complete sequences of sgRNA A1, sgRNA A2, sgRNA B1, and sgRNA B2 are provided below:

sgRNA A1 RNA sequence:
(SEQ ID NO: 11)
CCAUAGUCAUAACCACCACCGUUUUAGAGCUAGAAAUAGCAAGUUAAAAU

AAGGCUAGUCCGUUAUCAACUUGAAAAAGUGGCACCGAGUCGGUGCUUUU

UUU sgRNA A2 RNA sequence:
(SEQ ID NO: 12)
ACACCAAACAGAAUAUCAGAGUUUUAGAGCUAGAAAUAGCAAGUUAAAAU

AAGGCUAGUCCGUUAUCAACUUGAAAAAGUGGCACCGAGUCGGUGCUUUU

UUU sgRNA B1 RNA sequence:
(SEQ ID NO: 15)
AUGCUUGGUUAAUCAAUUAAGUUUUAGAGCUAGAAAUAGCAAGUUAAAAU

AAGGCUAGUCCGUUAUCAACUUGAAAAAGUGGCACCGAGUCGGUGCUUUU

UUU sgRNA B2 RNA sequence:
(SEQ ID NO: 16)
GACUUUGGUCAAAUACCGAUGUUUUAGAGCUAGAAAUAGCAAGUUAAAAU

AAGGCUAGUCCGUUAUCAACUUGAAAAAGUGGCACCGAGUCGGUGCUUUU

UUU

The CRISPR expression vector (crP) was previously assembled for CRISPR-Cas9 mediated cleavage in Gram-negative bacteria. The crP plasmid is a shuttle vector containing a pUC origin of replication, a pRO1600 origin of replication, a kanamycin resistance cassette, and an *S. pyogenes* Cas9 gene operably linked to a pTet (tetracycline) promoter. The crP plasmid also contains a scaffold into which a segment of synthetic DNA can be inserted so as to permit the transcription of two sgRNAs (e.g., using a dual-guide cassette) by the synthetic J23119 promoter. The nucleic acid sequences of the 'dual-guide cassettes' for sgRNAs A1 and A2 as well as sgRNAs B1 and B2 are provided below:

Dual-guide cassette (sgRNAs A1 and A2):
(SEQ ID NO: 21)
CAGACCTAAGGTCTCTTAGCCCATAGTCATAACCACCACCGTTTTAGAGC

TAGAAATAGCAAGTTAAAATAAGGCTAGTCCGTTATCAACTTGAAAAAGT

GGCACCGAGTCGGTGCTTTTTTGCTAACTGATACCGACTACGCCTGAAC

AGTCGAATCTTCACCTCGTCTGGTACCGACGCGGTCCCTTGACAGCTAGC

TCAGTCCTAGGTATAATGCTAGCACACCAAACAGAATATCAGAGTTTTCG

AGACCAGCTCGTAGGCTAA

Dual-guide cassette (sgRNAs B1 and B2):
(SEQ ID NO: 22)
CAGACCTAAGGTCTCTTAGCATGCTTGGTTAATCAATTAAGTTTTAGAGC

TAGAAATAGCAAGTTAAAATAAGGCTAGTCCGTTATCAACTTGAAAAAGT

GGCACCGAGTCGGTGCTTTTTTGCTAACTGATACCGACTACGCCTGAAC

AGTCGAATCTTCACCTCGTCTGGTACCGACGCGGTCCCTTGACAGCTAGC

TCAGTCCTAGGTATAATGCTAGCGACTTTGGTCAAATACCGATGTTTTCG

AGACCAGCTCGTAGGCTAA

The 'dual-guide cassette' for sgRNAs A1 and A2 was PCR amplified, digested with the restriction enzyme BsaI, and ligated into a BsaI-digested crP plasmid to create the 'crP-A' CRISPR expression vector. The 'dual-guide cassette' for sgRNAs B1 and B2 was also PCR amplified, digested with the restriction enzyme BsaI, and ligated into a BsaI-digested crP plasmid to create the 'crP-B' CRISPR expression vector.

The donor template vectors for each site were designed as follows. FIG. 9 shows the donor template sequence for K2 phage genomic DNA that was cleaved with sgRNA A1 and sgRNA A2 (SEQ ID NO: 2). FIG. 10 shows the donor template sequence for K2 phage genomic DNA that was cleaved with sgRNA B1 and sgRNA B2 (SEQ ID NO: 3). The donor template sequences contain the nanoluciferase reporter gene with an upstream ribosome binding site (RBS), as well as the region of the K2 phage genome between the two CRISPR cleavage sites that is to be excised, such that the original sequence and function is restored. Specifically, the donor template sequences included 5' and 3' flanking regions (about 300 bp in length) that were perfectly homologous to the cleaved ends of the wild-type K2 phage genome so as to facilitate strand invasion and homologous recombination between the cleaved phage genome and the donor sequence, thereby repairing the double-stranded breaks and incorporating the nanoluciferase reporter gene. The protospacers/PAM sequences within the donor templates were modified such that the CRISPR system would not recognize and cleave the donor template, and would only target the wild-type phage genome. For example, the regions internal to the two cleavage sites (i.e., right of the upstream cut site and left of the downstream cut site) were either codon-reassigned or otherwise changed by single-base pair substitutions that were not expected to detrimentally affect phage function.

The recombination plasmids for each site were assembled by PCR amplification of the plasmid 'pBBR1-Gent' with primers 'CPM 123' (5' CAGGTTCATCATGCCGTTTGTG 3' (SEQ ID NO: 25)) and 'CPM 124' (5' TATTTGCCCATG-GACGCACAC 3' (SEQ ID NO: 26)) followed by a Gibson assembly reaction between the amplified plasmid and the donor templates. The assembled recombination plasmids for site A and site B were designated as 'pBBR1-K2 A' and 'pBBR1 K2 B' respectively.

E. coli UPEC was transformed twice to make strains housing either 'crP-A and pBBR1-K2 A' plasmids or 'crP-B and pBBR1-K2 B' plasmids. These strains were maintained with kanamycin at 50 μg/mL and gentamicin at 10 μg/mL. Cultures of these strains harboring the specific combination of CRISPR expression vector and recombination plasmid were grown to mid-log phase, and either not induced or induced with 100 ng/mL anhydrotetracycline (aTc) to express the Cas9 gene. A 100 μl aliquot of the cultures was plated into a top agar bacterial overlay with wild-type K2 phage. After an overnight incubation, plate lysates were collected and analyzed genotypically.

Results. The phage present in the bacterial overlay (plate lysate) were obtained by applying ~3 mL LB broth to the plate, allowing the phage to diffuse into the broth over time, and collecting the broth. PCR reactions with primer sets that flanked the intended Nanoluc insertion sites were run using these plate lysates as templates. For both site A and site B, induction of the Cas9 gene stimulated recombination between the wild-type K2 genome and the donor template plasmid. For site A, the phage population appeared to be completely recombinant, whereas for site B a mixed population was recovered. See FIG. 1.

Figure 2A:
FIG. 2(A) shows the luminescence activity profile of individual plaques that were generated from the recombination experiments in E. coli UPEC strain harboring crP-A (site A cutting plasmid) and pBBR1-K2 A (site A donor plasmid).
Figure 2B:
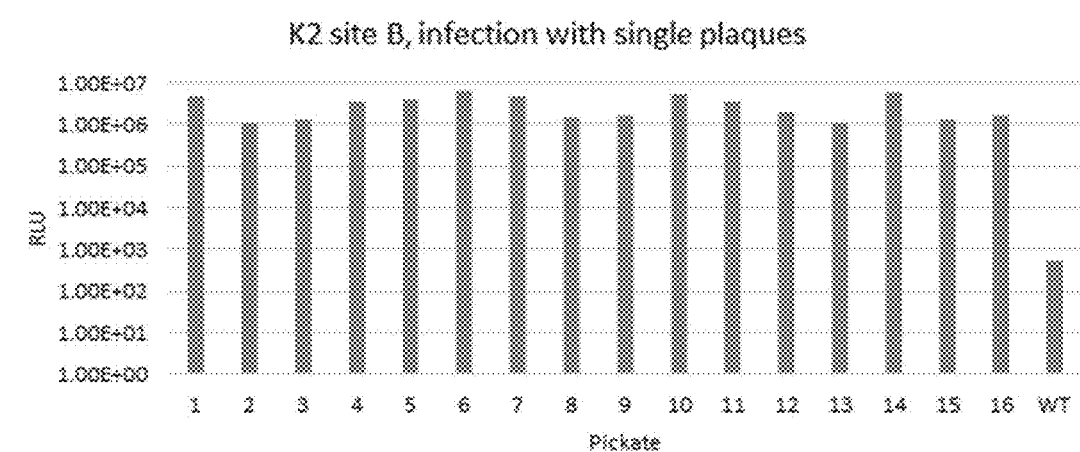
FIG. 2(B) shows the luminescence activity profile of individual plaques that were generated from the recombination experiments in E. coli UPEC strain harboring crP-B (site B cutting plasmid) and pBBR1-K2 B (site B donor plasmid).

The plate lysates from the recombination experiment were then serially diluted and plated on a wild-type E. coli UPEC overlay such that single plaques could be recovered. Single plaques were picked into 25 μl of Tris buffer, and 5 μl of each 'pickate' was used to infect 150 μl of mid-log E. coli UPEC for 2 hours. FIGS. 2(A)-2(B) show the relative luminescence reading (RLU) of each infection, demonstrating that recombinant nanoluciferase containing K2 phage were successfully recovered.

Figure 3A:
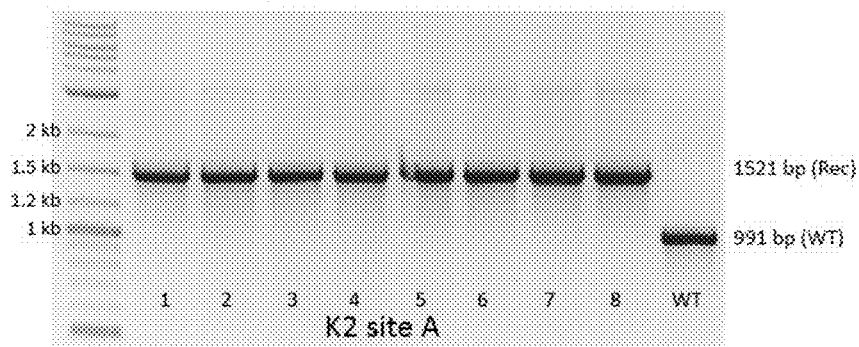
FIG. 3(A) shows flanking PCR assays that tested for the presence of recombinant NanoLuc® K2 bacteriophage using primer sets that flank site A.
Figure 3B:
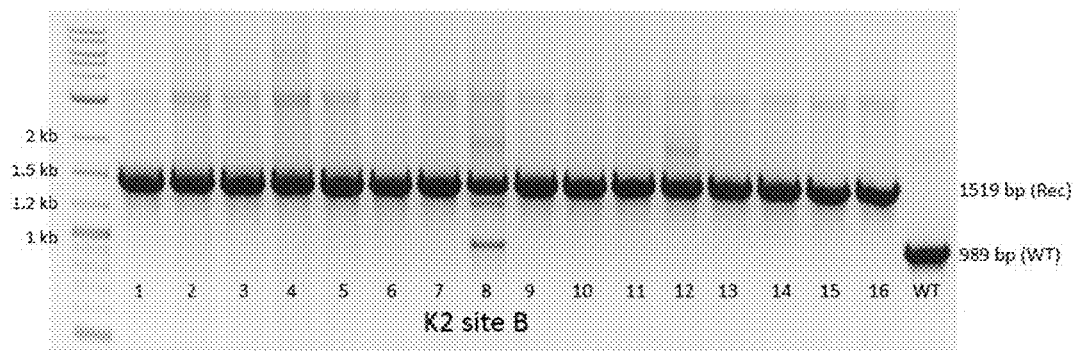
FIG. 3(B) shows flanking PCR assays that tested for the presence of recombinant NanoLuc® K2 bacteriophage using primer sets that flank site B.
Figure 12B:
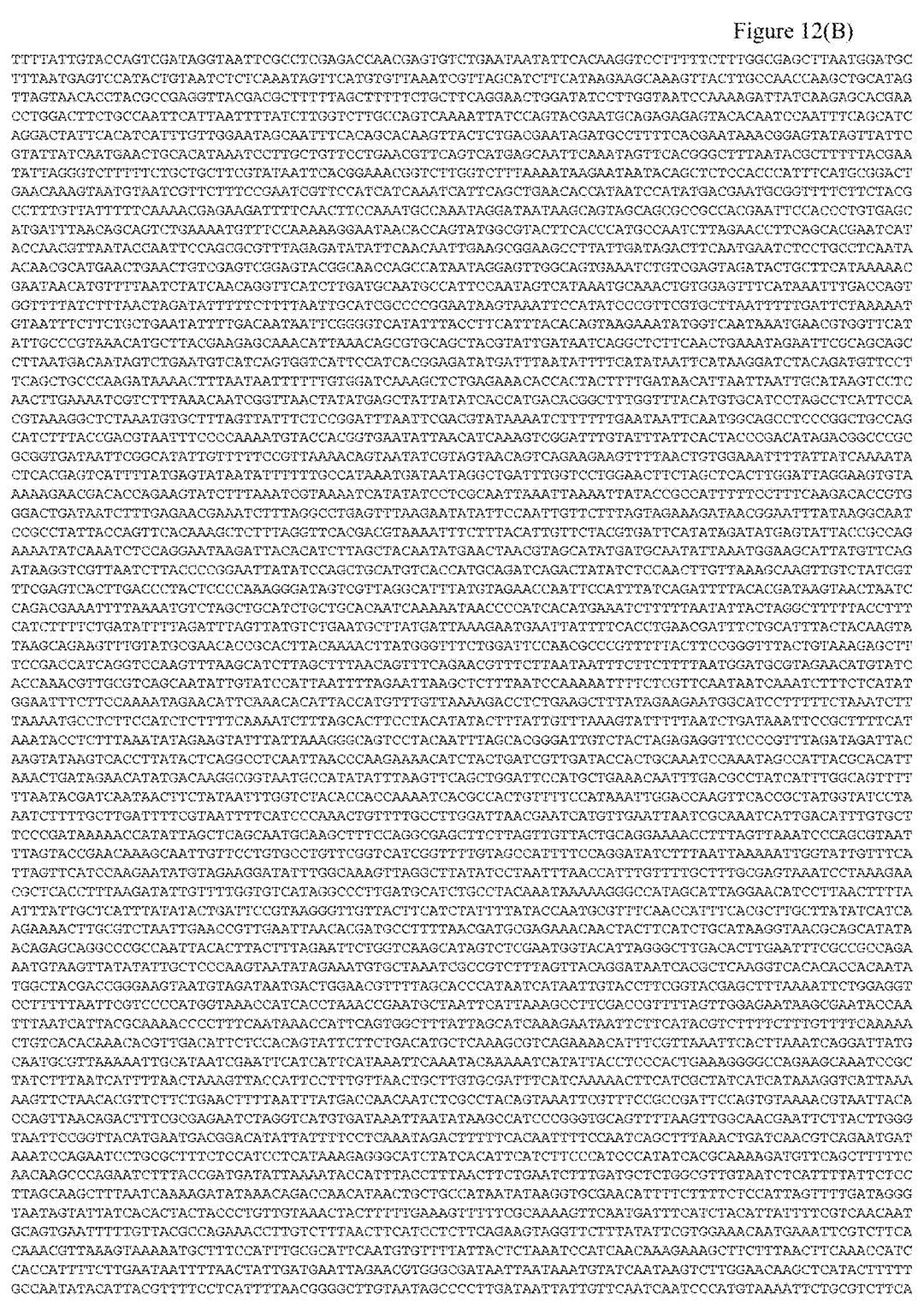
Figure 12Q:
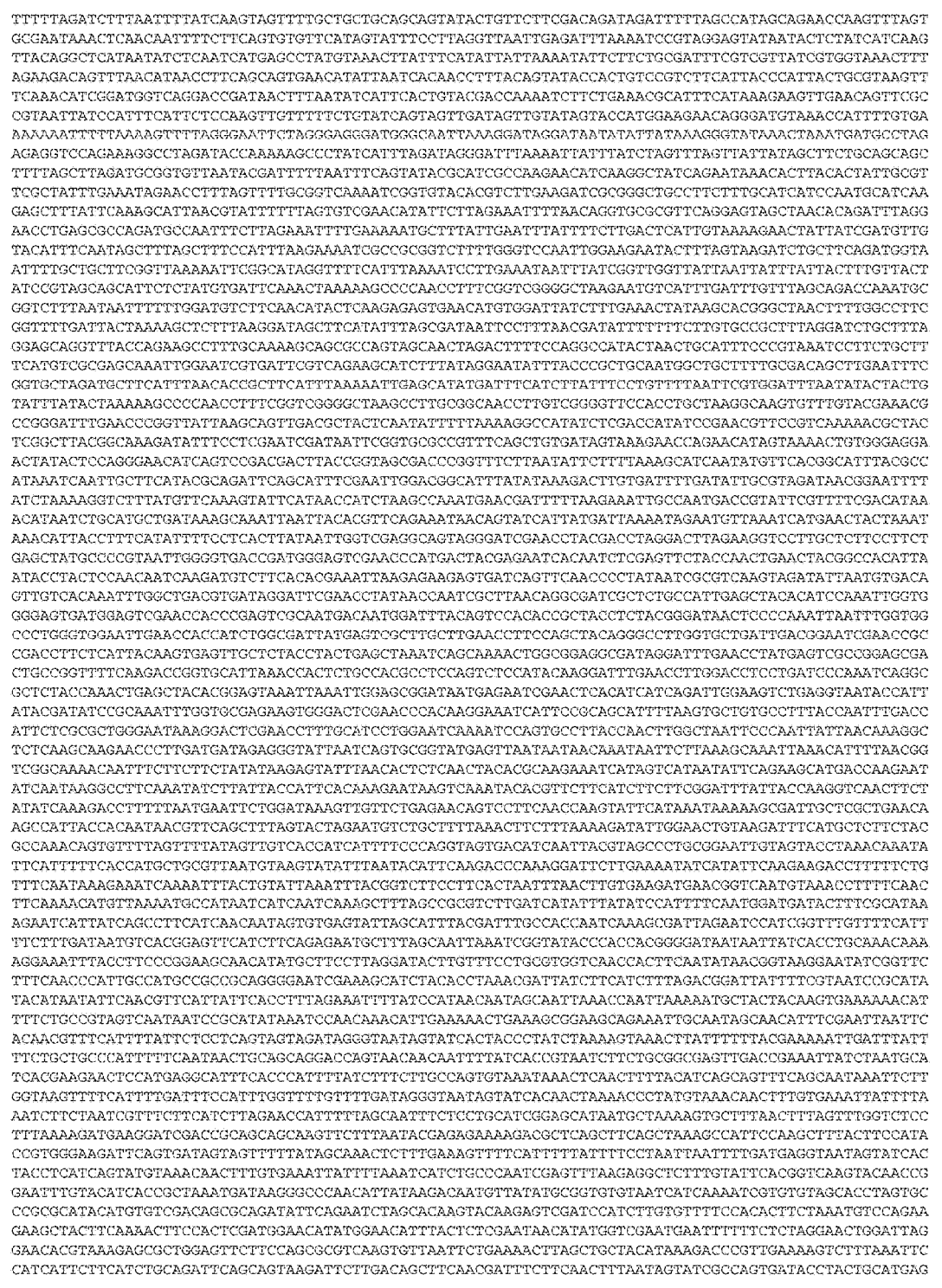

Two hour infections with each pickate shown in FIGS. 2(A)-2(B) were then used as templates for PCR reactions using the appropriate primer sets that flank the nanoluciferase insertion at either site A or site B. With the exception of K2 site B, pickate 8, all pickates appeared to be pure populations of recombinant K2 phage. See FIGS. 3(A)-3(B). For K2 site A, pickate 1 was selected for sequencing and further characterization. FIGS. 12(A)-12(S) show the partial genome sequence (i.e., contig-1) of the recombinant NanoLuc® K2 phage that was cleaved with sgRNA A1 and sgRNA A2 only (SEQ ID NO: 23). FIGS. 13(A)-13(S) show the partial genome sequence (i.e., contig-1) of the recombinant NanoLuc® K2 phage that was cleaved with sgRNA B1 and sgRNA B2 only (SEQ ID NO: 24).

Figure 4:
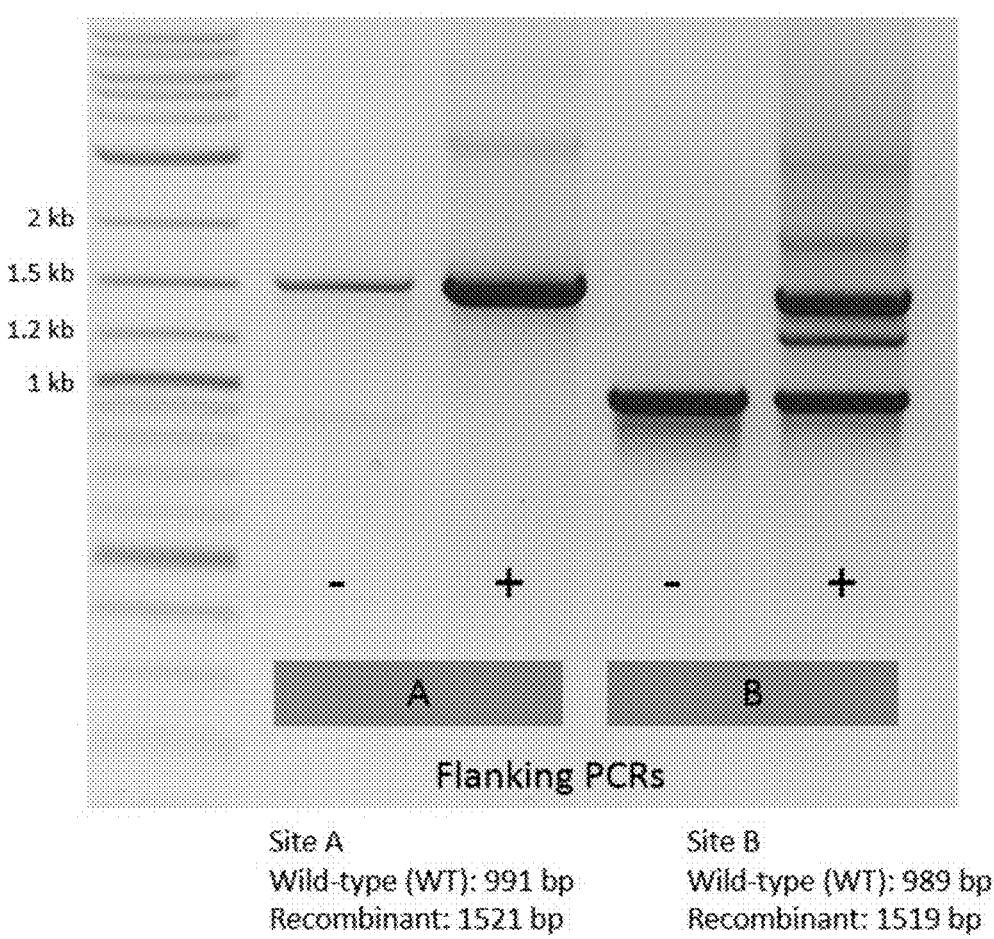
FIG. 4 shows flanking PCR assays that tested for the presence of recombinant NanoLuc® K2 bacteriophage in sgRNAs B1+B2 bacterial strain under different induction conditions. An overlay of E. coli UPEC harboring crP-B (site B cutting plasmid) and pBBR1-K2 B (site B donor plasmid) was infected with 'K2A', a recombinant K2 phage with nanoluciferase already inserted at site A. This was performed with and without tetracycline induction (100 ng/mL). Plate lysates were collected and analyzed via PCR using primer sets that flank site A and site B.
Figure 5:
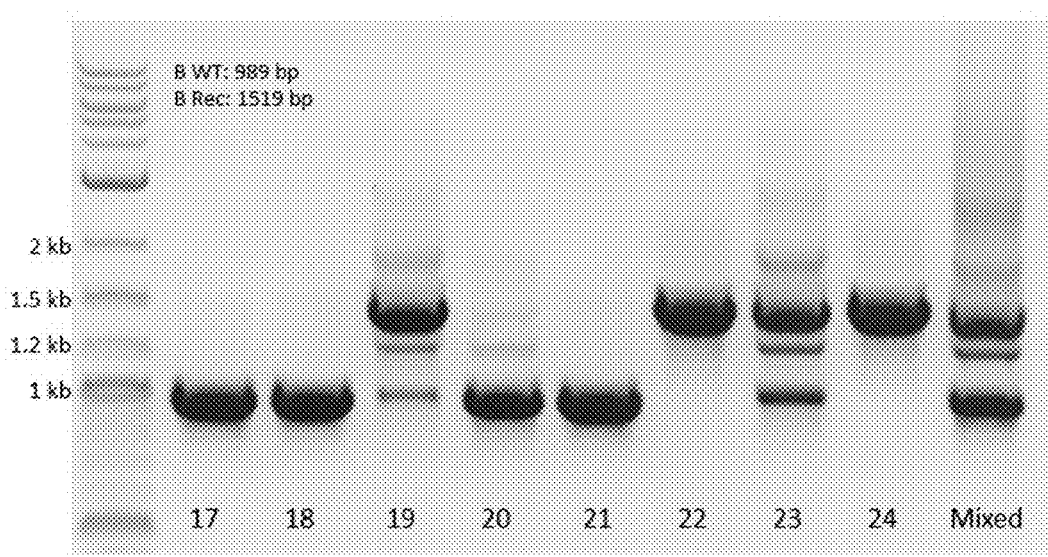
FIG. 5 shows flanking PCR assays that tested for the presence of recombinant NanoLuc® K2 bacteriophage using primer sets that flank site B. Recombinant K2 phage containing a nanoluciferase insertion at site A ('K2A') was used for these recombination experiments.
Figure 6A:
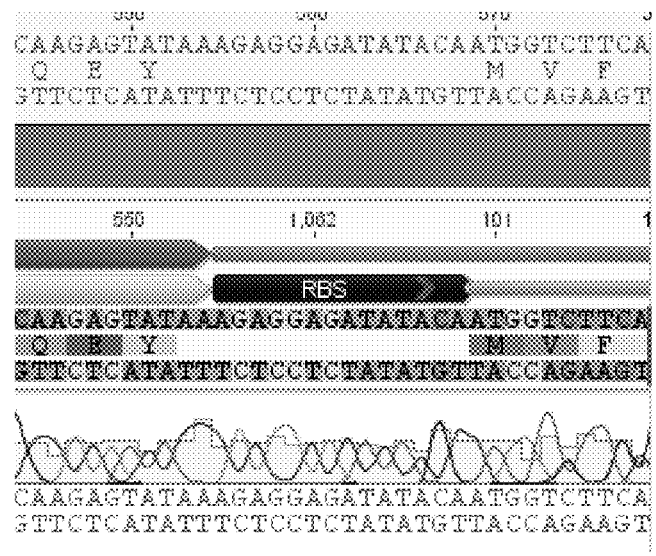
FIG. 6(A) shows the upstream junction sequence of the nanoluciferase insertion in the recombinant K2 phage genome cleaved by sgRNAs A1 and A2: 5' CAAGAG-TATAAAGAGGAGATATACAATGGTCTTCA 3' (SEQ ID NO: 5).
Figure 6B:
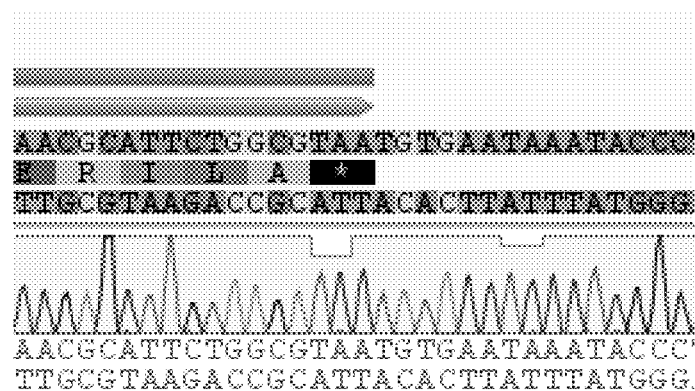
FIG. 6(B) shows the downstream junction sequence of the nanoluciferase insertion in the recombinant K2 phage genome cleaved by sgRNAs A1 and A2: 5' AACGCAT-TCTGGCGTAATGTGAATAAATACCC 3' (SEQ ID NO: 6).
Figure 6C:
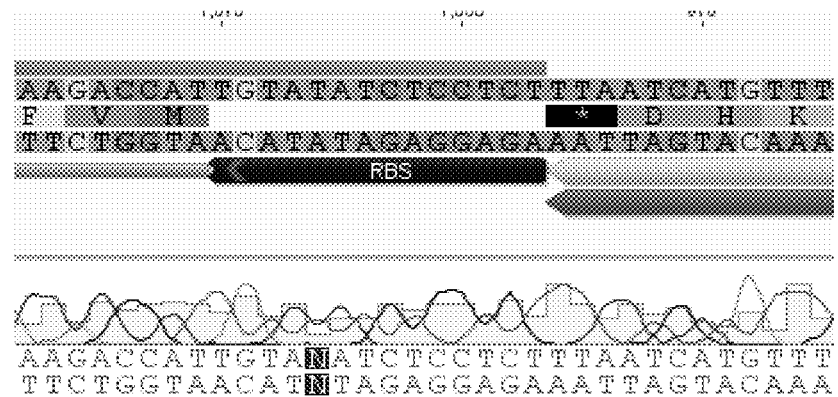
FIG. 6(C) shows the upstream junction sequence of the nanoluciferase insertion in the recombinant K2 phage genome cleaved by sgRNAs B1 and B2: 5'AAGACCATT-GTATATCTCCTCTTTAATCATGTTT 3' (SEQ ID NO: 7).).
Figure 6D:
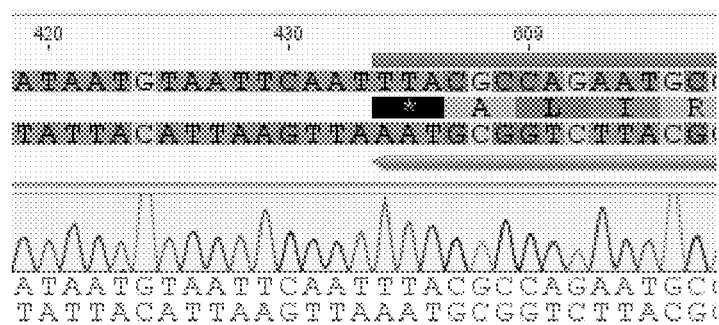
FIG. 6(D) discloses the protein sequence as SEQ ID NO: 29.
Figure 11C:
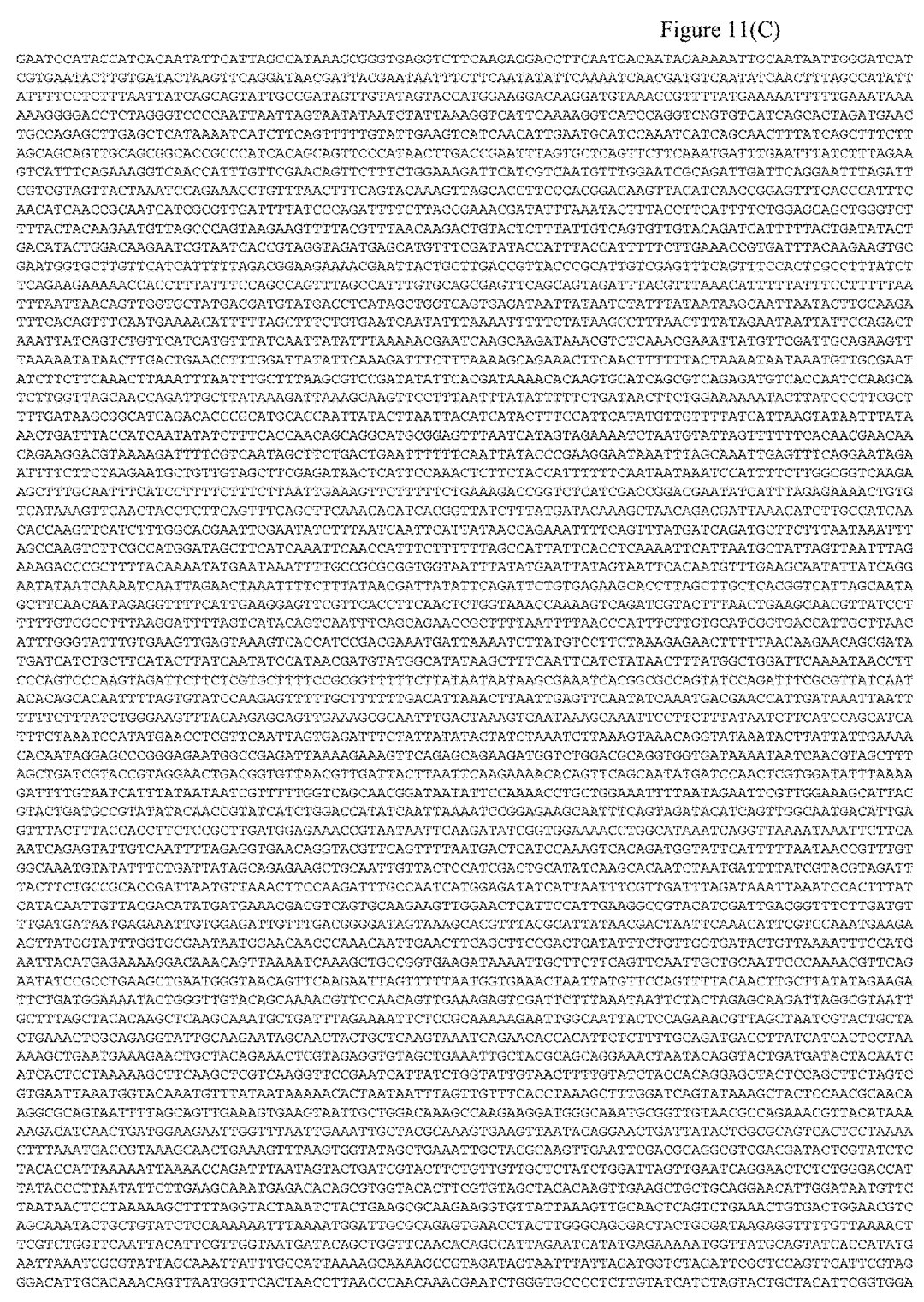
Figure 11K:
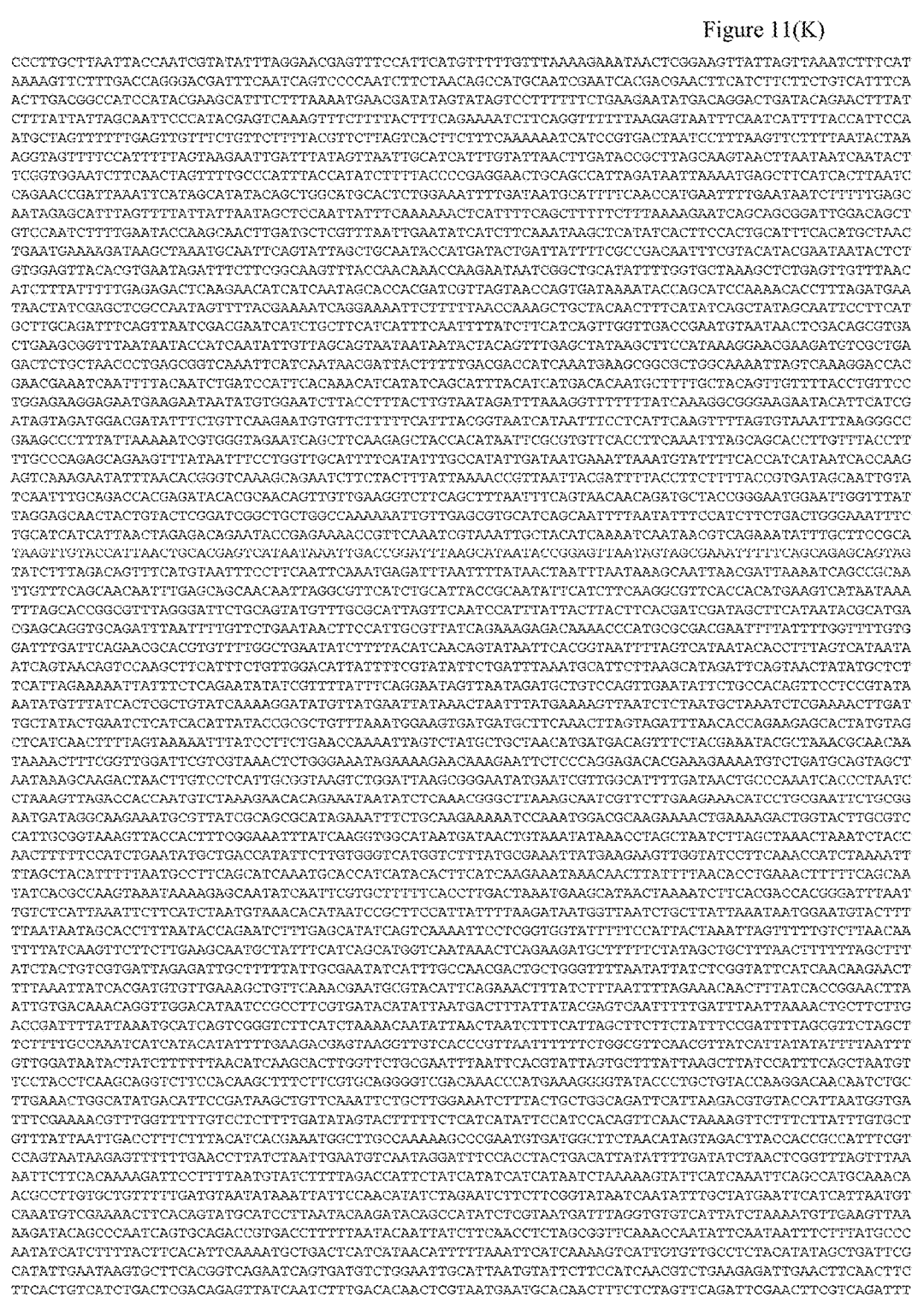

K2 site A, pickate 1 (K2A) was used in follow-up experiments to make a recombinant K2 phage having nanoluciferase insertions at both site A and site B. An overlay of E. coli UPEC harboring the crP-B and pBBR1-K2 B plasmids was infected with K2 site A, pickate 1 with or without tetracycline induction. Plate lysates were collected and analyzed via PCR using flanking primer pairs for site A and flanking primer pairs for site B. A mixed population of phage containing a nanoluciferase insertion at site B was observed (FIG. 4). The plate lysate for this phage population was subsequently diluted to single plaques and individual pickates were analyzed via PCR using primers that flank site B. As shown in FIG. 5, pickates 22 and 24 appear to be pure populations of recombinant K2 phage containing a nanoluciferase insertion at site B. Because 'K2A' phage was used in these experiments, these pickates were then presumed to contain nanoluciferase insertions at both site A and site B. FIGS. 11(A)-11(S) show the partial genome sequence (i.e., contig-1) of the recombinant NanoLuc® K2 phage that was cleaved with sgRNA A1, sgRNA A2, sgRNA B1 and sgRNA B2 (SEQ ID NO: 4). FIGS. 6(A)-6(D) show the upstream and downstream junction sequences of the nanoluciferase insertions at site A and site B within the recombinant K2 phage.

These results demonstrate that the methods of the present technology are useful for making the recombinant K2 bacteriophages disclosed herein in a bacterial host cell. Accordingly, the methods disclosed herein are useful for generating recombinant K2 bacteriophages that can be used in the identification and/or antibiotic susceptibility profiling of specific bacterial strains/species (e.g., bacterial strains/species that express K2 capsule genes) present in a sample.

Example 2: Functional Activity of the Recombinant K2 Bacteriophages of the Present Technology This Example demonstrates that the recombinant K2 bacteriophages of the present technology are useful for the identification and/or antibiotic susceptibility profiling of specific bacterial strains/species (e.g., bacterial strains/species that express K2 capsule genes) present in a sample.

Figure 7A:
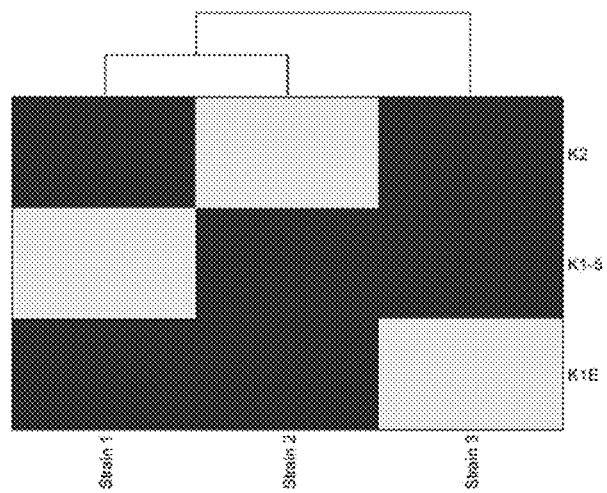
FIG. 7(A) shows a comparison of the host ranges of recombinant NanoLuc® K2 phage, recombinant NanoLuc® K1-5 phage, and recombinant NanoLuc® K1E phage. Grey means the tested phage infects the corresponding strain (positive) whereas black means the tested phage does not infect the corresponding strain (negative).
Figure 7B:
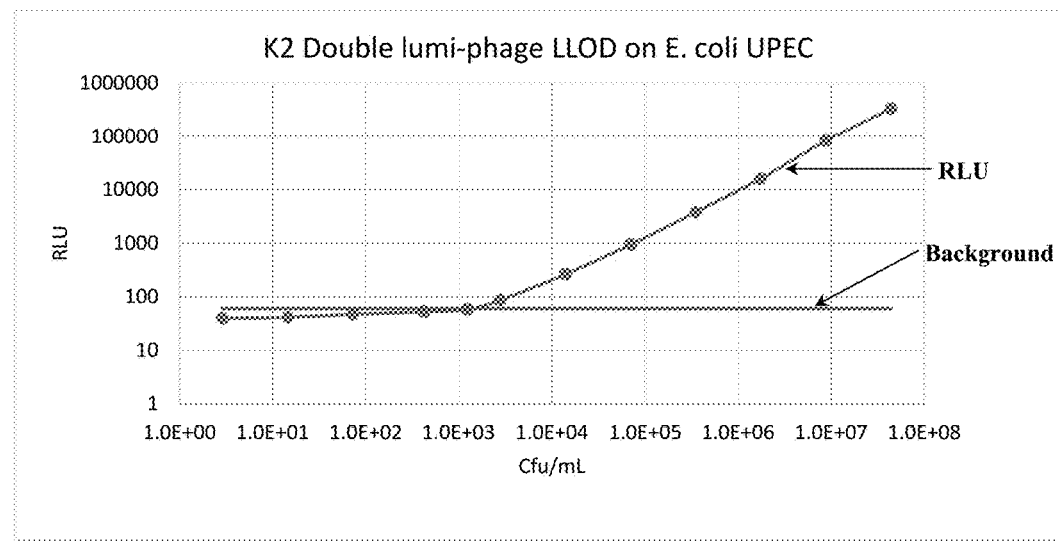
FIG. 7(B) shows the luminescence activity profile of a recombinant K2 phage of the present technology (SEQ ID NO: 4).

Approximately $1\times10^5$ Pfu of recombinant K2 phage having nanoluciferase insertions at both site A and site B were added to 100 μl cultures of E. coli UPEC strain at an OD600 ~0.1. The infection proceeded for 1 hour, after which time RLU was recorded. Each data point is the average of five replicates. The background lower limit of detection was determined by recording RLU of phage added to media alone (12 replicates). As shown in FIG. 7(B), the lower limit of detection for the E. coli UPEC strain is 2800 Cfu/mL using $1\times10^6$ PFu/mL of the recombinant K2 phage of the present technology.

E. coli clinical isolates (designated as strains 1-3) were infected with the recombinant NanoLuc® K2 phages disclosed herein, a recombinant NanoLuc® K1E phage, and a recombinant NanoLuc® K1-5 phage for 1 hour. FIG. 7(A) shows that the recombinant NanoLuc® K2 phages of the present technology successfully infected an E. coli clinical isolate (strain 2) that was incapable of being infected with a recombinant nanoluciferase expressing K1E phage or a recombinant nanoluciferase expressing K1-5 phage.

These results demonstrate that the recombinant K2 bacteriophages of the present technology are useful for detecting target bacterial strains/species present in a sample. Accordingly, the recombinant K2 bacteriophages disclosed herein are useful for the identification and/or antibiotic susceptibility profiling of specific bacterial strains/species (e.g., bacterial strains/species that express K2 capsule genes) present in a sample.

Example 3: Antibiotic Susceptibility Profiling Using the Recombinant K2 Bacteriophages of the Present Technology Antibiotics were prepared by performing eleven 2-fold serial dilutions in Mueller Hinton Broth (Sigma, St. Louis, Mo.) in 96 well microtiter plates at a final volume of 100 µl. One column contained broth only and served as a no drug control.

Cells from an overnight growth blood culture in 25% human blood and 75% Tryptic Soy Broth TSB were diluted 1:10 in Mueller Hinton Broth. From this dilution, 5 µl of cells was added to each well of the antibiotic plate. Cells were pretreated with antibiotics (Ceftazidime, Gentamicin, Amikacin, and Levofloxacin) for 120 minutes at 37° C. After the 120 minute pretreatment, 10 µl of phage suspension comprising the recombinant K2 phage of the present technology (1E6 pfu/reaction well) was added to each well and incubated at 37° C. for 45 minutes. After infection with the phage, 50 µl of the reaction was added to 50 µl Nano Glo Luciferase Substrate (Promega, Madison, Wis.) in a luminescent plate and read in a luminometer. The minimal inhibitory concentration (MIC) of each sample was determined using the ETEST® method (Biomerieux, St. Louis, Mo.) according to the manufacturer's instructions. The differences in the reporter gene expression of the recombinant K2 bacteriophage observed in the antibiotic treated samples and the untreated control samples is defined as µ.

FIGS. 15(A)-15(D) demonstrate that the recombinant K2 bacteriophages of the present technology were effective in determining the antibiotic susceptibility profile of two different *E. coli* strains SS11 DL21 and SS3 DL05.

These results demonstrate that the recombinant K2 bacteriophages of the present technology are useful for determining the antibiotic susceptibility of a bacterial strain or species in a test sample. Accordingly, the recombinant K2 bacteriophages disclosed herein are useful for the identification and/or antibiotic susceptibility profiling of specific bacterial strains/species (e.g., bacterial strains/species that express K2 capsule genes) present in a sample.

EQUIVALENTS

The present technology is not to be limited in terms of the particular embodiments described in this application, which are intended as single illustrations of individual aspects of the present technology. Many modifications and variations of this present technology can be made without departing from its spirit and scope, as will be apparent to those skilled in the art. Functionally equivalent methods and apparatuses within the scope of the present technology, in addition to those enumerated herein, will be apparent to those skilled in the art from the foregoing descriptions. Such modifications and variations are intended to fall within the scope of the present technology. It is to be understood that this present technology is not limited to particular methods, reagents, compounds compositions or biological systems, which can, of course, vary. It is also to be understood that the terminology used herein is for the purpose of describing particular embodiments only, and is not intended to be limiting.

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, particularly in terms of providing a written description, all ranges disclosed herein also encompass any and all possible subranges and combinations of subranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like, include the number recited and refer to ranges which can be subsequently broken down into subranges as discussed above. Finally, as will be understood by one skilled in the art, a range includes each individual member. Thus, for example, a group having 1-3 cells refers to groups having 1, 2, or 3 cells. Similarly, a group having 1-5 cells refers to groups having 1, 2, 3, 4, or 5 cells, and so forth.

All patents, patent applications, provisional applications, and publications referred to or cited herein are incorporated by reference in their entirety, including all figures and tables, to the extent they are not inconsistent with the explicit teachings of this specification.

SEQUENCE LISTING (29 sequences)

SEQ ID NO: 1 - DNA, 117427 bp, Escherichia phage K2
  modified_base (4494)..(4494): a, c, t, g, unknown or other
  modified_base (4497)..(4497): a, c, t, g, unknown or other
  modified_base (12685)..(12685): a, c, t, g, unknown or other
  modified_base (61129)..(61129): a, c, t, g, unknown or other
atgtgtttccagaaaatttcttctttaactacatcatctttacgagtatcgccttgtttgcgttggatatgcaaattaaacggaatatcgttttgtaaaagccactcacgtgtcataacataatattttaacttagcattttcggtgccagattcacgtccgcttacagtaataatctcataacccgagtgatgaagcatcttcagatattgtacaaccatttcgtttggtgtatcggttgataatttatctaattcgtatgggccacgagatgtatgaatagctagtgttccatcaaggtcaaagattgcagcttttggtttaccaggagtccctttgtataccggaagaccgagatactctcgcatacttttatacattgagcgtaaaacatcaattggtactgctttagttccacgttttgagttacgtttaaccaattcagtccaaggaacatcaaacactttatattcaactttccatccgtattctttggcaaaagtttcccatgctaggcgacgttcaggattcaagttagtgtctgaaataattactcccttgacagaatcaccgccgtacagaatactcttcgcggtatcaaactgcataccggtcacaatgccttctttctttttggtatacttgtactcgtcacgttcttcatgacccatgatggattgacgataatcatcacgattgatattataaaatccaggatttttagcaataaattcacgagcccaagtgctcttacctgaaccaggacagccaatagttaaaataatctttttcatcatttaattcctaagaaaacttcaagaatacgaatattatgctcacgtcgctctttatacacttcagctgttgattgattcactgatttgctctgaacattagatgaaataaattttatcatgtgatttttaagctgatacatatcaagtccacgagcttttgcttcttttcgtagagctttaccagcgtcatctaaagctttcgtagggtcttcatcatttaatactattccacgatccaaatccatgtatactgcaccatgacatgcatcaatgtaaaggtctgagcattcaatataacgttctaacagagttttcatttatttttctcaactaatgattgaatataatcatgcaggtctttagatgctttaccccacttattttgatattcatttttgagattagcacgggattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatgacataccgacccaagctttaccatcaataactttaacttgccaagatagtttagcttcatcatatgactttatctgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaataaacacttcacaatcatacttagcgagttgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgtaaatccatcataaagtcctcatgttatgtcagtaagtctactataacacaacacgaggggtttgtaaacagcttagtatccttctgggataaattttttataatttttcaaaaaattctgttcgatttcacacatgaccttttcttgactatcgtacccctggtataagctcatgatgataccgaacagatgttccattccagcacctttagcaacgccttgcgcttccattgcataagtctttctatccttaccacaatgtttattgtgacagtcaagaactaaaaacagagctcggtctaagtacttcagataagtcgtttcaaacgcctcaatttttctgtatgaatattcatcatcagcgtacattgctttaagatcatctgatgcaccatcaataatagtcttaaacagtttttctggattgtctaatgagctttttgtactatgaagagacacgtaccagtcagacttaattttaaaatgagaaccatctttcatcacagcaacatagccttcgatgttttccgcatttttagcttcttctacccatttagggctatcgatttcgtatcgttcaactagatatggacgaagaacagcatctttataaatgtcatcatatgaaatgtattcacctgtttcattttcacgaatattcaataaaatgattttcacctcttgataagcaagaacgattctattagttggagcgacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcatctggaagtaaccaatcagaataagatgcataattatatgagaaaattctgtaagttcttccagatgcacttacatcatctgagtaaaaaaacttacgctgtgaatccttacatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgcggcgcggattgaacattatcagaattaaggtattcacgaatccaaggatatggatgtttaaccggagcaccggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgntcncactctttggcaattttaacccattcatcaccatcagtgccaagttgaagttgacgaataatatattgtgtacctttaaggtggagttgctcatcacgcgcaataaatttcataatcttcgcgttaccttccatgatttccatattcttatggaagttgaaagtacatgcaaaagatacataaaaacggatagcttccagggcattgataacgtgcaagcagagataaagcgacttcatcaggtcacgtttacaacctgcaacatggtcaatagcgtcttggacaagttcttcatcatgctctgttgccaggtagaattctacgtcagctttagcgttttcccattcacgagtctttaccagaacatcatcataataacgaccaatcgattcagcacgtttcatgattgcatcatcaagaataatctcatcaaataccttggcagggtcattgaacaggttacgcatgatgtgagtataagaacgtgagtgaatagtttcactgaatgtccaagttgcagtccatgtatctaatgacgggtcagaaatcaatggcatcagtactgctgcaggagcacgtccttgaatactatctaacaatgactgatatttcaggttgttagtaaaaatattttgctgatactgaggaagcttattaaactgtgcagcatccatcatcaagtttacttcttcaggacgccagaaaaatgataattgcttttcggttaaatcttcaaaaactttatgacgttgaatatcataacgtgcaataccaagacctgaaccaaaaaacataggttcttttaaaacatcaactggatttgtattaaaaactgtgctcataaattttccacttagttaatagttggtgactcgtccatgagtcaaattatatcataatttacaggatgaacaatcttcagcttttggagtttctatttcataatcatcagtaccagaaccgtcacgggtattatgataatagaaattttttccgccaaaataccagaaatacaaaaggtcatcaatcattattgacattggaaccttgcctttagggaagatttgggggtcatagtatgtattcgctgaagctgattgacatacccatttcagcataatagctacctgcgtaagataaggtttattacctttcttagctaatttccatgtataatcatataagtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcacaaggtcctttttctttggcgagcttaatggatgctttaatgagtccatactgtaatctctcaaatagttcatgtgttaaatcgttagcatcttcataagaagcaaagttacttgccaaccaagctgcatagttagtaacacctacgccgaggttacgacgctttttagctttttctgcttcaggaactggatatccttggtaatccaaaagattatcaagagcacgaacctggacttctgccaattcattaattttatcttggtcttgccagtcaaaattatccagtacgaatgcagagagagtacacaatccaatttcagcatcaggactattcacatcatttgttggaatagcaatttcacagcacaagttactctgacgaatagatgccttttcacgaataaacggagtatagttattcgtattatcaatgaactgcacataaatccttgctgttcctgaacgttcagtcatgagcaattcaaatagttcacgggctttaatacgctttttacgaatattagggtctttttctgctgcttcgtataattcacggaaacggtcttggtctttaaaataagaataatacagctctccacccatttcatgcggactgaacaaagtaatgtaatcgttctttccgaatcgttccatcatcaaatcattcagctgaacaccataatccatatgacgaatgcggttttcttctacgcctttgttatttttcaaaacgagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcggaagccttattgatagacttcaatgaatctcctgcctcaataacaacgcatgaactgaactgtcgagtcggagtacggcaaccagccataataggagttggcagtgaaatctgtcgagtagatactgcttcataaaaacgaataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgttcgtgcttaatttttgattctaaaaatgtaatttcttctgctgaatattttgacaataattcggggtcatatttaccttcatttacacagtaagaaatatggtcaataaatgaacgtggttcatattgcccgtaaacatgcttacgaagagcaaacattaaacagcgtgcagctacgtattgataatcaggctcttcaactgaaatagaattcgcagcagccttaatgacaatagtctgaatgtcatcagtggtcattccatcacggagatatgatttaatattttcatataattcataaggatctacagatgttccttcagctgcccaagataaaactttaataattttttgtggatcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaacgacaccagaagtatctttaaatcgtaaaatcatatatcctcgcaattaaattaaaattataccgccatttttcctttcaagacaccgtgggactgataatctttgagaacgaaatctttaggcctgagtttaagaatatattccaattgttctttagtagaaagataacggaatttataaggcaatccgcctattaccagttcacaaagctctttaggttcacgacgtaaaatttctttacattgttctacgtgattcatatagatatgagtattaccgccagaaaatatcaaatctccaggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcgtcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatatatttaagttcagctggattccatgctgaaacaatttgacgcctatcatttggcagttttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccatattagctcagcaatgcaagctttccaggcgagcttcttagttgttactgcaggaaaacctttagttaaatcccagcgtaatttagtaccgaacaaagcaattgttcctgtgcctgttcggtcatcggttttgtagccattttccaggatatctttaattaaaaattggtattgtttcattagttcatccaagaatatgtagaaggatatttggcaaagttaggcttatatcctaatttaaccatttgttttgctttgcgagtaaatcctaaagaacgctcacctttaagatattgttttggtgtcataggcccttgatgcatctgcctacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcgtctaattgaaccgttgaattaacacgatgccttttaacgatgcgagaaacaactacttcatctgcataaggtaacgcagcatataacagagcaggcccgccaattacacttactttagaattctggtcaagcatagtctcgaatggtacattagggcttgacacttgaatttcgccgccagaaatgtaagttatatattgctcccaagtaatatagaaatgtgctaaatcgccgtctttagttacaggataatcacgctcaaggtcacacaccacaatatggctacgaccgggaagtaatgtagataatgactggaacgttttagcacccataatcataattgtaccttcggtacgagctttaaaattctggaggtcctttttaattcgtccccatggtaaaccatcacctaaaccgaatgctaattcattaaagccttcgaccgttttagttggagaataagcgaataccaatttaatcattacgcaaaacccctttcaataaaccattcagtggctttattagcatcaaagaataattcttcatacgtcttttctttgttttcaaaaactgtcacacaaacacgttgacattctccacagtattcttctgacatgctcaaagcgtcagaaaacatttcgttaaattcacttaaatcaggattatgcaatgcgttaaaaattgcataatcgaattcatcattcataaattcaaatacaaaaatcatattacctcccactgaaaggggccagaagcaaatccgctatctttaatcattttaactaaagttaccattcctttgttaactgcttgtgcgatttcatcaaaaacttcatcgctatcatcataaaggtcattaaaaagttctaacacgttcttctgaacttttaatttatgaccaacaatctcgcctacagtaaattcgtttccgccgattccagtgtaaaacgtaattacaccagttaacagactttcgcgagaatctaggtcatgtgataaattaatataagccatcccgggtgcagttttaagttggcaacgaattcttacttgggtaattccggttacatgaatgacggacatattattttcctcaaatagactttttcacaattttccaatcagctttaaactgatcaacgtcagaatgataaatccagaatcctgcgctttctccatcctcataaagagggcatctatcacattcatcttcccatcccatatcacgcaaaagatgttcagctttttcaacaagcccagaatctttaccgatgatattaaaataccatttacctttaacttctgaatctttgatgctctggcgttgtaatctcattttattctccttagcaagctttaatcaaaagatataaacagaccaacataactgctgccataatataaggtgcgaacattttcttttctccattagttttgatagggtaatagtattatcacactactaccctgttgtaaactactttttgaaagtttttcgcaaaagttcaatgatttcatctacattattttcgtcaacaatgcagtgaatttttgttacgccagaaaccttgtctttaacttcatcctcttcagaagtaggttctttatattcgtggaaacaatgaaattcgtcttcacaaacgttaaagtaaaaatgctttccatttgcgcattcaatgtgttttattactctaaatccatcaacaaagaaagcttctttaacttcaaaccatccaccattttcttgaataattttaactattgatgaattagaacgtgggcgataattaataaatgtatcaataagtcttggaacaagctcatactttttgccaatatacattacgttttcctcattttaacggggcttgtaatagccccttgataattattgttcaatcaatcccatgtaaaattctgcgtcttcagaatccataccatcacaatattcattagccataaagcgggtgaggtcttcaagaggaccttcaatgacaatagaaaaattgcaataattgggatcatcgtgaatacttgtgatactaagttcaggataacgattacgaataatttcttcaatatattcaaaatcaacgatgtcaatatcaactttagccatattattttcctctttaattatcagcagtattgccgatagttgtatagtaccatggaaggacaaggatgtaaaccgttttatgaaaaatttttgaaataaaaaaggggacctctagggtccccaattaattagtaatataatctattaaaggtcattcaaaaggtcatccaggtcngtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttactacaagaatgttagcccagtaagaagttttacgtttaacaagactgtactctttattgtcagtgttgtacagatcatttttactgatatactgacatactggacaagaatcgtaatcaccgtaggtagatgagcatgtttcgatataccatttaccatttttcttgaaaccgtgatttacaagaagtgcgaatggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgcagaagtttaaaaatataacttgactgaacctttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcttggttagcaaccagattgcttataaagattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatatatctttcaccaacagcaggcatgcggagtttaatcatagtagaaaatctaatgtattagttttttcacaacgaacaacagaaggacgtaaaagattttcgtcaatagcttctgactgaattttttcaattatacccgaaggaataaatttagcaaattgagtttcaggaatagaattttcttctaagaatgctgttgtagcttcgagataactcattccaaactcttctaccattttttcaataataaatccattttcttggcggtcaagaagctttgcaatttcatccttttctttcttaattgaaagttctttttctgaaagaccggtctcatcgaccggacgaatatcatttagagaaaactgtgtcataaagttcaactacctcttcagtttcagcttcaaacacatcacggttatctttatgatacaaagctaacagacgattaaacatcttgccatcaacaccaagttcatctttggcacgaattcgaatatctttaatcaattcattataaccagaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccgcgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacaatagaggttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttgtgcatcggtgaccattgcttaacatttgggtatttgtgaagttgagtaaagtcaccatccgacgaaatgattaaaatcttatgtccttctaaagagaactttttaacaagaacagcgatatgatcatctgcttcatacttatcaatatccataacgatgtatggcatataagctttcaattcatctataactttatggctggattcaaaataaccttcccagtcccaagtagattcttctcgtgcttttccgcggtttttcttataataataagcgaaatcacggcgccagtatccagatttcgcgttatcaatacacagcacaattttagtgtatccaagagtttttgcttttttgacattaaacttaattgagttcaatatcaaatgacgaaccattgataaattaattttttctttatctgggaagtttacaagagcagttgaaagcgcaatttgactaaagtcaataaagcaaattccttctttataatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggtgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttggtcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataaccgtttgtggcaaatgtatatttctgattatagcagagaagctgcaattgttactccatcgactgcatatcaagcacaatctaatgattttatcgtacgtagatttacttctgccgcaccgattaatgttaaacttccaagatttgccaatcatggagatatcattaatttcgttgatttagataaattaaatccactttatcatacaattgttacgacatatgatgaaacgacgtcagtgcaagaagttggaactcattccattgaaggccgtacatcgattgacggtttcttgatgtttgatgataatgagaaattgtggagattgtttgacggggatagtaaagcacgtttacgcattataacgactaattcaaacattcgtccaaatgaagaagttatggtatttggtgcgaataatggaacaacccaaacaattgaacttcagcttccgactgatatttctgttggtgatactgttaaaatttccatgaattacatgagaaaaggacaaacagttaaaatcaaagctgccggtgaagataaaattgcttcttcagttcaattgctgcaattcccaaaacgttcagaatatccgcctgaagctgaatgggtaacagttcaagaattagtttttaatggtgaaactaattatgttccagttttacaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtagctgaaattgctacgcagcaggaaactaatacaggtactgatgatactacaatcatcactcctaaaaagcttcaagctcgtcaaggttccgaatcattatctggtattgtaacttttgtatctaccacaggagctactccagcttctagtcgtgaattaaatggtacaaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacgcaaagtgaagttaatacaggaactgattatactcgcgcagtcactcctaaaactttaaatgaccgtaaagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattggataatgttctaataactcctaaaaagcttttaggtactaaatctactgaagcgcaagaaggtgttattaaagttgcaactcagtctgaaactgtgactggaacgtcagcaaatactgctgtatctccaaaaaatttaaaatggattgcgcagagtgaacctacttgggcagcgactactgcgataagaggttttgttaaaacttcgtctggttcaattacattcgttggtaatgatacagctggttcaacacagccattagaatcatatgagaaaaatggttatgcagtatcaccatatgaattaaatcgcgtattagcaaattatttgccattaaaagcaaaagccgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactacatcgggtgatcagactggtggatttaatggattacgtccattgtccattaataatcaatctgggcaggtcacaattggtgaaagcttgatcattgctaaaggtgctactataaattcaggtggtttaactgttaactcgagaattcgttctcagggcactaaaacatctgatttatacacccgcgctccaacatctgatactgtaggattctggtcaatcgatattaatgattcagccacttataaccagttcccggggtattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcgggaccatatgttaaatttcaggataatcccgttggaaatcaaacatttagcgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatatgaaagtgtcgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgcccaagcaggtcaaggcggcatgagaaatttaagcttttctgaagtatcaagaaatggcggcatttcaaaacctgccgaatttggcgtcaacggtattcgcgttaattatgtctgcgaatcggcttcacctccagatataatggtacttcctacacaagcctcttctaaaactggcaaagtgtttgggcaagaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaaccacaggcagctgataacgatttcgtttctaaagctaatggtggtacttacaccggtccaattactattaattacggggtaaatagttatcttcaattaagtaataatgaaacccccattcgaattcgttctggtggcggtaccggtaatactcttgtagttggcggctcttccggcggtattagttttagacctgcaggtagtgaaatcactactggacaaattactattacaccagaaggtttgacaacatttaccagggctgtaacggctccatcgataactgttacatctactccttccgcagcatctgatgttactcgtaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctattaatttaaaagataaaacaattttcacaaaagatgactcaggcaatgttatagaattaggtttaaaatatggaggaactataaatggatctttagaggttacagaaaatataactggaactttaattggaaattctagtacagctactaaattgcaaacacctaggaaaattaatggtatatcttttgatggatcaaaggacattacactaactccatctgatataaatgtaaatagtacaacatttataaaaaataacggcgaattacccgttgatgctaatttagatacatacgggcccattgaagaatatcttggtgtttggtcgaaatctacttcaacaaatgcgcaaccagcaaataaattcccagaagaaaatgccgtaggtgtactagaagtatttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggagaaacagttcaagagcaatcgcatcatttgatcgccattatccagaagaaggatcagccgcacaaggatttttagaaatatttgaaggtggtttatacacaagaacgcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcctgggttatataatattttaggcactgatgccgttattaactgtcctaccggtgaaggtttgccgactgttattgttggtttgctggaagttaaacaacgtgcttctggcggtgctattttccaaaaatttactactgccggaacgggtgcaactactcgcgatcgtatttttgagcgtgcatatactggtggtgtgtggggtacatggaacgaagtatatacatcttactctttgccaattactttgggtatgggtggtattaaagcccaattagcggagctagattggcaaacatttgattttgttcctggtagtatgtttagcgttcctttgaacaaaataaagaacatgccagcaaatatgaattggggtacaattgacggaaacttagttatgttttctgtcggtcctagcgaacacaccagcacaggacgtactgttcaggtttggcgtggtactgtatccaagacaaactaccgttattttgtcgttcgtgtgttcggtaattctggaaatagaacttgcacagttcgccgtgttgttcttgaagacggatcacatacttggactgctcaacaagattttaatggtgctgttaactttggtagttcaacaacgtttaaatcaactacaacatttaatacagaagttaaatttcgctcattgaatgcattccgtatgtatggcggaaaatttggtacatttttacgtaatgatggagagagtctttatattctttccaccgacgaagatgatcaagatggaaactttaatacaaatagacctttccgttatgaattaagaactggtgatgttactttgggtggtgctagtggtgctaacgttttaaaattaaaacgtgattctctcaccgcattttttggcggtgatattaacattaaaggcacgatgacttttgacgccggacgtttaggatcacgagattattttaaatttaaccattggggtgatagtaataatgcgcgtgataatatcatccagttagaagacagcaaaggcgctcatttttccactgaacgtactttagcgactggtgcaattaagactaaattttttggtgaaattgaatccgatggtaaattggttattaaacgtccgggtgattctattgtattatcaacaactgctagtaattctttgcatattcgcggtgatatagacgggactggtaactggtatattggtaaaggtggtgctgataatggattagcgttctatagttatgctactaatgctggtgtatacattacaaacggaggggatatcgcgctaagtccaaagggtgccgaaatggctcaggtcaataacgttcgattatatgttcatggtgaacgttggactgctagtcaaccaggtgattggggtcgtcagtggcaagtggaagcgccaatattcgtcgatcatggttatgttggaccagatagctattatccaattattaaaggaagaagtgtaatcaccaatcaagggtttgtaactgccgtcgatcttggtattcgtcgtgtcaataacaattggggacaagcaattattcgtgttggatctgcggaggcatcgccagcggctggacaccctaacgcgatatttgaatttcattacgacggtactttctattctcctggtaatggtaactttaacgatgtgtatattcgttccgatggtcgacttaagatcaataaagaagagttagaaaacggagcacttgaaaaagtatgccgactgaaagtttatacatacgataaggttaagtctattaaagatcgtagtgttattaaacgtgaagttggtattattgctcaggatcttgaaaaagaattatcagaagctgtatctaaagttgaagttgatggatctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagaaaattatggcagtagttggtgttcccggttggattggaagttcatccgtaaatgaaacaggacaacgatggatgagtcaagcagctggtcaattaagattgggtgttccttgctggatgagccaattcgccggacgctcaagagagattattcatactgtaagtgctaatcataattttaatggtcagtggttccgtgatagatgctttgaagctggcggtgcacccattgtattcaatattgttggtgatatcgtttcttattctaaagatgttcctttattcttcatgtacggggatacgcctaatgaatatgttgttcttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggtggttatgactatggtaacgcacactccggcgctggtggtaatgctggtgctgctggtcagaatgcatggtctgacggcggtaaagttcttaaagttggtgttggtggtgcgtctggtcatgcagtgtttggatcttctccaacttggggtgttgttggaacaatttacggaccaagagtataatgtgaataaatacccttaaaaggagggtctatggcagcacctagaatatcattttcgccctctgatattctgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtattggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctatgaattccttgaacgactcgcgttcctgagctacattatgctcgattaccttttcaagattatgactcattcgaaataatcttcaatttcgtaatcatggacataaatcattatagtttctaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcgcgtgtatcggtatatcccatctcaacaataaaatgccgtattagatttttatctttatcgttgagagaattaaaataatcggattttgaattaatttccctggccaatttgaatcaccttcagttggcgttttagctcttttatcatctcttcgttcatcgcaatataaagatcgcgtaaagcaagttttagcattccatttactggataactaaatggacatacataatcttttcctacgagctttttggtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaagataaatttcgtaagctgaatccataaaggaacttatagctgccatgaaattattgcgaatacctactggagcatctttactttcacgaataatcatgtatttgccagtcttaatctttacaatagttccaagataagccccatggtaccagatgtcccacccctcctgagtgggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactacgataagtttcaacctttttaagaacaaatccattttcatctaaaagttttaacatgaagtctttatcttcttccatatcagaagtaatctcgcgagctttacgagttgctcgttttttcagcagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttctaatctccgtaattctgtatcagtagttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagtttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatgacgttcttcttcattatcgctcaaagaatattctttgcggaatttaactttgaatccaaaaccatgctcaccgcaagcatcatcccatgtaatgaagcctttatcttcaagtgggtctaagattttactcacgtaagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgtaatacagctttcttaacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatatacgttatagaaatttttacttacacgagcaaaaatataacgacttgctgctgctttttggacggtacgagaaccaaagtttccttgaccatctaacagaggaaaattattattccaagtgttagccatcaaagcacctgcgtcttgcgcagagttttcaccatgatgatatccaaggtccgctacaccacctgcaatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctactaataaagcagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttgtttttaagattgttacgatagaactgcatcacatgttcgttatggaaattactcatacacaccacacattttgcataaacgttcaaaacagataaatccgccacctacacacatcacgacagccacattatcattaagaggtagacctaaagccgtaaagattccagtcaatgtgaataaggctaaaactaataggtaacccattacaaatagagctttcattagtatgcctgcaaaacaaatttaaagttatcagccaacatacggttcatttcttcaagtgtttgatactcagaatgatgattacgagtaaacgctaaagctaactgaccttttccaaatcctgtcgtcaaaggtttcatcttagaagcaggaagataaaatactgcatatggaacattgttatttgcaatagtacgcgcaagctgagaccgacgttgacgaatatgacttagaactgcgctgaatccttgcttagaacgttgattacctacataaaatcgtgcagacacacatggattactaaatggacgaccatctaatttacttactaaaaagtaaaatccaggtttagataaaatatctttatgcggagttcccaaaaaccactcaccacccttgattgtaccaataacagtagcacctgcatcattcagatcagtaacagtcatatatttcatattaatttcctctaaattattttctactccaaggccgcatgaatacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagttgatagggtaatagtaccacggaagaacagtcttgtaaacaactttttaaaaatattcgtaataaatgtgaataccaatcaccactgctgaaacctgtgcaacccaccacgcacaagcaataagtacagaattcaaaattttcataataacctcatcacaaaagtaaatgttaaacaaattaatggaatactaattaaccaaacgaaacaccaccataatgaactcatagttcaatctcagcaattttcatttcattactattaatagccgctttaagactatctgaaagaattacattccagtggtcattcatatgaccattaactaagcgtgtaatttcttcgggagttgaaaaataaggcgtatcagactcccaatgcgataatcctaagcgagtataaatcataccttcatcatcgctagaatattcaactgacacaaactcatcagttattttatgtttagcgtaataaaatttaaatttcattttccgctcctccgtagttgatagttgtatattaccacggtccttgtggtatgtaaaccgttttgtgaaaatttttaaatggaaagataccatccgttgtagttgctttttcttacaaccttacgaaggtcttctctgtcaccgatgaacttcggagtgtactggatgacacctgggtgaatttctttagtgttgaatataattatacagtcagcgacctgatgattcagaatgggccctagatttattccagaaccatatggatactctccgctgcatcctgttgttacagaaatccaacgtgagtcagtttgatgtgtcttaacttctacacgaagcccgcagtatcttggatgcgccaatacatcccatgcgtatgtatacgggtcattaacgtcctcttggcctttgttaacatacccgcttagccaatctgctacaaaaaactctgcgtacaccgcgatacggcatctttcgataacttctgccttatcctgatttgggttttgttttaaagagtatcttgctgtatcagcaattttgaccttcatttcactagtcaaatcactgttcgatagggtaaatgtcggaatctgaaatagtctctgtaaacccggattcgttttctgcatttagactttcctttttaccgctgagataagcgttatatactttaagagtgccgtaataaattcggtcattttcatctaaagactcacggtcaagttcatcgagttcctttttatccatgactataacatcattgcaataaagaaacccaagttttttgtgtccaaactcaaatttattacagtacacaatattagcgtgatgattaccatgtagagaaatttcttttatgtcggaatcaccgatattcatacaataaatcataattcaccttaaaacaaaagggccgaagcccttattttatttgaattgtgcaattcttttctctaaacagtcagcataagatttcattgagataaactgcgaaagtaacagttcttgctcaactgcactaactgttagaaactttgcgctttctaaaaatttgctcagtgcattaattttgagcattaattgatcgtattcttcttttactcgtgcttgataacctaacataattttccttagttaagggccgaagcccttatttaaattgttcagtaacgtcttcaactacttcgtattgacaggtacgcattttagcatcgttgtaatcaatcggaattgatactacatcacgcggatgtactttaacttttacaactcggctggttgaactgccaaagtgacgaatataagatttagaacacacatgcagaccgcgagaacaagtttgtgtatcatcgtcattcacacgagtacgtggcattttaactactttaccaggactgttatcaaaagtatttgaatgacagtcaaagtagttgtcacgaactactttccaagcatagaagtaaccatcttcggtgatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccagcttatccgctacaagcagattgagaatttcctggaagtttgaatgagtattaggtgttgcgttataagttacaccgtcaacagtaattgaaatgaattttttagatgcattccaaataatgtcagatttagcaactggagcaataactgcatcgctattaactttaactgtaatatcaccgctaatagtaactttagagcgtttagcttcttcagcatttttcaaaacacgacgaattgtgtcaaccgatacaccttgccaatcagccaattcctgttgggtgtaattaccacttgaatacaatttaacaatttcagcttgttcgtttttggtcaggcatttaatattgtacataattttccttattaggccgcaagggccttcatagttttagcgatttgggaaacttcatcatcatttaaagagttgcgataaccgatgaagtcggaaacaatacggaatttcttggtaaactcagcaaccattttatcactattttttgaagcattacgtgataattcatcaaagagattagttactgtccagatatcatgaccgatggtatcttttccaccattgaaatacacaccgcgtaatgaactaaccatattaccaagtcgtgtatattcttcagaaacttcgtctgtactgaagtacttcatcataaaatctagttcaggatacttgataattttatcaatatatcgttgagctgaacttgaataacctacatacttatcataatctacatcatcaaaagcatctacatataaatcacgcagagtttcaaaaatacattggcactgaccgagttcttttacctttttctgcaaaagcggacgaataacataaaattcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgctcattgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatgactttgcttaatgcgtttcagtcgagggtcaagatttacttcatacaccacgcctgcattgcataacttactatcaggttcaaacatactctgcatcttcttatatgacagatttttagtcgtgaatttgactgaattactaatcatataatctcgagcagaataccccatcttcattaattcgcgatatgtatgacgaggagatgtagattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccgttaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcagtcataatagcaatattatgataattcaagttttcagctttttcaccgagaactaatccagtgattgcgcaaatatcaaacaattctttgtttttaagcatatcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcattagaattgcttcattatttagaatagcacgtgaaatctttttagcatcaagttgaatatgactacggatttcgccaaatggagaagtcaaacgctctttagtttgagaatcaaatcgcatgtttttcatatcacggacaaacataacgatagtcaaacattctttaacgcgtgctttagtcacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagagcaattttcttgttcttgaacaatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacggatagtcgaatccttgaagaatagaccagaacacacggttccttctactttctgcccagtaggtccaatagcacgaaatccagtatgttggaaatcattttcagagcaaccgaaccagttgtatccagtgatttcaatattagtaaaaccacttgaagataaaactttggttgcattatcagcatcagtacatcctgctaaagacactgctaatactaatgctgcgatagaacgattaatatatttcatagttttcacttaaatttaatggcttgaaggagactaataattctcaagcgacttctttcatctttaaccgtaaatgaaagagggtcaccagatttcatagtgatagtgcattcaaaatcaaaaccttcggggacttcttcgaataggtcaaattcttcatcatatattagaacattactctgaaaactgtgaagaatttttccatcatttccagatgctgtactaatcattgtaacattattacctttcatatcttcaacgataaattcgcttgtagatattacggcattaatagaaccattcctataaatagcagaaaatagatatttcttttcttcaccttcgcgaatgcgatatttcttaccaattttaaacataattaccctttaagtaagtcgtaaaaaccaccattcacatgcttaggagcggaaactaaccgaatagcaatccgatgacaatcaggacatacatcagtatccctttcagaaattttcttgattttttcgtattcttttgcacagtctttggattgacatttataatcataaagcggcataattattccttaaagtgtgctttcaacatctgatacaaggaccatgcttgttcattattttcaatagtaacgttcataaccgggaattcagatggatcagttattgttgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttagaagataattcttcccgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacatgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcagaatatctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccatcgatggtgcttacatcttcatctgatggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttccttgctaaatcgcgaatttgacctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataaccgccttataaagatggctaatttcacctaaaatgtaatcactgattgtaacagtttttacttcaccacaaaagaattctaacgcaatcaaatctcgttcaatttcttccaattgaagcattaacttgcctgattcaattttcacgtttttgcgatttttactataagctatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatagcctcacacataaaacacatcataacgaccacgggtaacaccaacataaagaagttgttgggccaattcagcatctgcataatgaatacaaggcgtataaatgaaagcacggtctacagacataccctgagctttatggaatgttgatgcaggaagtgctttcactttactaaactgtgatttagcatcccaaaaatcactccatggagcttttccgcctttgttccaatttttataagtttctgctgttttacctaaaaatagattaaacttatataactcttcatcagatgaaattattttaatcttttcacgataatattcatcatcgccgtaagtttctactgttaaatcccaatgacgaattagatattccccaggaacaccacgagctttaacaaacgttgatgtatactcagcttctataatacgaactaattgtccgttattaaaaataatttctgatacaggctttccatcaattttatatgttttaattaatggttcctgcattacaataatttcaccaacaataaaatctttatcagtttcaaaaatctttttacgaataatgctatttaacttatcaacagatttattcgtaaatgccattacgcgattttcaaacaaatcatctagtgatttgacgattgaaaaataatttaccataaaatcgcgtaaagcggtatcaccggtaaatccacgtactccatgcccgtcaacaactttatcataaatccacttaccgttacgaacatcagtagctacatcaataataggagcattactgcgtttaacttcagtaagttcacactgataaaaatctttgtgtgtaaagaatggactgatataagcagtattttctcctgggtcaacaggtctaatttgcttattatcacctattccaattatggtacaccatggcgggatagttgaaagcagaattttaaatagctttctatcatacattgacacttcgtcgcagattaatactctgcatttagctaaatccggtacttctttttgttcaaaaagaacgttttcttcatatgttactgggttaattttaagaatgctatgaatagtacttgcttctttccctgatagttttgaaagaatctttttagccgcatgagtaggagctgctaaaataataccagtttcacccgtagatattaaagcttcaatgatgaacttagtaagagtagtcttaccggtaccggcaggtccattaatagttacatggtgtttcttttctttaatagccttcataacaatgttaaaggcatttttctggccttcggtcaaatcatcaaatgtcatcgtaaattccctgcaattggtatactaacaatacgcccagtatctaaaattcgctgatataatctttgtgtgtctacgtcgggcttaacatgtttaacttctattttattaaaccaaaacttgcgtggagtctcaactaatcttggaattcccttacctaaagctaatcgatactgctctttaagagtggtaaatactttatcagcaatcttccattcaaaaaatacagcaggacgatgttcatcaagtggaactggcgcaataaatccatctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataatccttagcttaatgtcagaggtttgttttgatttagaaagctgtgaaatgtgttcaattcggttttcacgttttttctgtatagctttaatttgattataggtctttttgattttagcccatttcttttcatctaaatttagtttatgaacttttttcgcagatgaacgaccaattcgcaaagcaaataaatcacgcttttcaatcaactcctctaaagtataatcagaacgaaatgtattatactttttctttactgcaataacattccctttaatgtatccaatgttattatcaaaacgttctaatgataatttctctccttcaatacgattatcaaaaggttctcctgagtaagcgcaaactttctgatctaaaatgttcttaatgtaattgaagtctaagttaaaatctttagaacgtcttttagcagatgcctgagtgtgctctaaacgacgtttaattttacgaatttgattattagacagtttcatatttttctcacatcttacggacgatttaatacttactataacatttttacttcagattgtaaacaactttatgcaaaaatgctttaaaaatttcatggtataatgaatctaagtccttccattatagattaaatccttcaaagtcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgtagagcttttatagcatactcctggaaattgaataccataggagctttgaattcaaaaataacctgtgtgttatactctaaaccggaagcaaaatgtatagctatatttttatcatatgaagctgatacgactttatcaaatgtaataatatcaattccttgatttaacgcttgcttagtctcgactggaacacctctccaaagaggtttatcgtttggaaccaaacgagatttgactatttcatttaaccaagaatgatcgtctggtttattagtaatacaatgaattaaaagttcaatttcagataaattaaatccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattttatactttccaattggaatcatccattcttgttcacgtacaatcatcattaagttatcagtacgttctgaatctaatccatcagtatcttcatatgtatacttaaattcagtattaggagaagaaagtataatatcgctgatatggtcagaataattaaaagctttatcagtttttaagcgaaatattatttcagtgaaatactcaacataagaaaaaccacatgctgtgcgcaaactagtagtaaatgaatctactctgttcgttgaaaacacttctccaacttgtaaatctttaatgagttcttttgtcgattttgatataccacgatatagctgataaggcgatttagttaaatgctttttaactattttattcaactgccgatgaagagcttcattctttttggcttccatacactgccaaagaactgactgttcaaagtcagtaaatttttcacagacctttttgtacatatcatattgaaaatcgacactttcagcttttatagataactgttcaacatctgcgagattaataatcatgatagcctccatatacttcagaagctatcatatcattgttaggaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaataacgattagcttcaataatctttctttcttcttcagatattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcaacactaatcattgatttcatccattcttccgattcgttctgcatttctttatttgcttgttcaacccaaccatcatcaatatacatcgagtttggtctattgaaccattcaagcatcttcttcagagctttcatttgttttacctaaaacaatagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataactcttatcaatcattactgctacggtaattggaacgtctttagcaaacgacatactaatactattgatagacatttcaaacaaaatcgcttccataattttcctcaatcacaagatgtagatgaacaactagaatcacaagaactttcacatgaatcgcccgtccatacatgaacaggaacattagtatcatatgaatcagaactagactgtgtattctgtgcattagatgatgtagtaggtactgaccagcgccaaggatttttataatattcttgggcttcttcataagtcatagtaactgcttctactgttccatctcccatataaacatactcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattaattttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctctttcttctttttaggaatctgttcaggacctttatttactacagcgcctgacgttgttccagtagagatattttcaggattaccacctgaatctccagctaccatatcttctttaataaattctttatatgttttcatattaacctctattcataaaagcattaaaaatttggtcatcaatagatggcacagtaatattttctgcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacctcactattaaaacgtggttcatggaaactgtaataaaccttttcatctataaaatcgtatgaaattttttccatttttaaatatgaaaattcagaactatacatattaacctttattcataaaagcattaaaaatttgatcgtcaatagaaacatttactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaatattccaccgacatactctgtgctgcgtttaaagtttacacgtttcctaaatgaaaaatattcaggttctttatgagcccgactcataggacacaatgagtagctagaataagagatgtcaaatcctacaccttcaatatgagccaacgcgtcatgattaaaccaattataatcatatgccaaatccattatattgtaatatgtgaaaggcaccggattaacatcatgtgttgtacctttaaaatctgcccaggcaacgatttcgttatctttaacaattacaaaaattgtgtcaataagatatccacggttattttcatcaggcgttatattataacattgcgcatcaggaaatttaccgtatttaaacggtggatttttgtgcatataataaatcatattattcacctgtgatttcggttacgatatttttgttattaaagtttttatcgcaatacagaacataattatactgcattacaccaccagacttaagttgtttttgcactttagctttcatttcgggacgatcgcgctcaacaatattcataatatccgcttcaatttgagtttcaacttcagtctgatctgcagtcatagaccattcacacaagtctttatcatatcctgccatagcaggctgagcagcacaagaagccaaagtaaaaattgtagcaaaaataaattttttcatgataatctcctcagtagtttatgtttatatagtatctcaatttccaacaaaagtaaacagctattttaaaacttctgcataatcacatgttacaaactgtttctctagcttaacgattttacgaaaataccttttatactgacgaatctgcctcttcgtaggacgtacagcaaacttaataaattccactcgaccaaatggaggactttcttctgctggaatatctaacaccaattcccacgtatccgcaataagtgctttgaattgcgtatttttcctgacgttatacggagtaggtttaaataaaacaatatgcatattatcctcggtaatctacttcacatactttcttgtcatcaatgaaagctttaactagtgctttattaacttcagcatattgagtagtagcccattgaacgtcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgatcgaaatgtattagcatctgctccaccagtaggatactgtttaacgattaaacgaccgagagtagatttctcacgccatttttccatttttcctttatactcagcgtaagaaatatgcccatcatcaatgtcatcaagagaaacatcaagcatattagcatcaatacgtttagcgcagacttcttctgccatttccatggaaatgtaaagaacattatgtccgagctgtaaataatctgctgccaatgaacacagacctaatgacttaccaacgttaacgccagccattaaaacgttcagcgttccagtttcagctccgcctttagtaattttgtttagaattctgagtttaaatggaaccttacgagctttattcatataagatagccaacgtgcttcgtagtcatccatccaatcatgaccaacgtaactatcaaatgaaattgataatgcttggcgcatgatgtcaggaatagcaccaacatccggcattttcttatttcgtttttccggaggaagctcagcattagtttgaatttcaattattttagatgtggcgttaaacatcgccctttgctgaacatatttttctgtttcttttactaaccagctgtggtcttccggagaatcagccagttttgaaataagtgtttttacaccagaatattctgtttcagtaaatgaactattttctaatgcaacatttaacgcattaatagatggaacgctatgatactcgttgacatgagatttaattaatttgaatgtatttttagctggaccactttcaaaatattctgaatccatatatggccaaacttttgaaaaataagcttgatcaaatataagatgagaaagaataatttctaccacacttactccttaaaagaatttaaactttttctttgaccttttattaaatgcatcttgtagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcggatttaattatcttaagagattcattaaaaagacgttcttttctttcttcttccccctccgaagagggggattcatcgataatttctagatctaaatctaaatcatctttattcattaaattcttccatatcacttaactgctcgaggtcagtttctaaatcagcagctgatttacttttactttctggagatttaaatttttcaacctttgagttaatcaattcatcgacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcaccggtttcttcgtcaagaaattcacgagcataccagccatttttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttccgtttctttcttagaagccatattaccgattgagtcgatgaatacaataaccttttcaccacgctcaatagcttcaagctggttcaccatatcaattttcagttgttcaactgactgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaattgcaccagaaatagcaatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttgcgcgaaacacacatgcgaagaacctttaatggctcgtcttcttcacccaacgattttcgtttttcaatattagaagttttccaacgagcttgctctggaaactctctattgatttgctcaagagctctattatgttttgaattactacgaattgaactgcacccgcccggagcctgtgcttttccagatacaaccagatatttgaacaaggccaaatgcggataaccttgattaattaaattgagaaatgcatacatatcttcgcataaatcaatttttccatacccaatttgttctgttgtaagttttccaaggtcataccaagtattcgtgaatccatatgaattttcacgataattaccccaagatgaagtaattttaaaaataggtagacgagcatggccatgataataaccgcaatccatggcatctttaacgtattgaatcaattcatagaactgttcacgagttaattgattaattttatctacacagcgacgatcatctttctttcgcattgaactcatacgaatagtagtatcatcatcaatcatccaaattcgttgacctgcatacatatcagtaattgctttacgagtaccagcaattccgttaacatcatcaggaatagttataattttagctctagacccgtaagcgtcataataagctttttcttcgtgttcacgtactacaatatgcggttcataatcagatggaaacatatcaagggcagaaactgcccctacgcgttgatagcttggaattacgaattgaatcatttccactcaccgttataatcttttttcgcaatatgtgtttcaccagttttccaccaatggtcaaccaaataaaaatgacgggaatacacatgaaggctcccgacattccatataatggaacctgctttatactgacgagttgaatcacctgcattcaaatcagatactaatttatctaatacgtatttttgccatgcataatcattacggaatccgaagaccacgtcatttgaacgcatgcttactactgcattgactttcttatcacgaatcaggtactgtactgtattcgtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaaccccaacctaaaataatagttggaatcataagaggaaccgttacactatagtatatacttattataatcatcaagattaaaagcaacactgctataattttgcttttcattccttctctctgatgataattacctgatttggttgtgcagactttttagtttcacccgcaattgaccaaataaatgtaataaaccaaccaataattgaccagttaaacagtaaagacgtgaaaaagattcctactgttgattttgacccacgcatcaaggcgatgaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccagtacgccattggtaattattagcccaattagcccaaatttcggcgcagtagttttcaattttttcttcgcgtgtaattacatcagaattacgatatgcttgagcagattcatctggacgaatagcttcgtcaaaatttgcctgcatttgttctactgtttgctttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagatttaatcacaggttgagtatcattttcaacactaacaaatggaactgctactaatgcaactaaacaaactgctaagcatcccataacaattttcattttattctccaaatctgtatcagtagttgatagttgtatagtaccacagaggaacagtcttgtaaacagttttgtgaaaattttttagggaattctaaaggtccaaaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacgggcatttaaatcctggccaacctttatcatcatatttcgctatatcgttcgcagtttttacttcagcaataactttatagtcaagttgacgatattctttctcgaagttcttgtaatattcttggacagactcttcaccttcttgaagaatacgacgaatactttcttcgagagcttcttgtactgcttttggtgttgaactctgctgagtttccatacccatgatttttagatgtggttcagcaaatcgcttatcttccatatcataaacgttcagagcataacgttttttcgctttccaaaatccaccaacaccctttgaaccaagcggaggacaagaaatagcttcacggtccatatgcatcagatgctcgcgattattcatataatcacataactcacgatatgcaacatcaatcataggttccatctttttcttaccgaactgattcatgaattcaactaaatcattttgttctttaaagcggtcaagacctactttttcaataactttatctacacaaacatataccgaatcagtatcacctgctgcgatgaaatcttcaccattagttccacatactttattnagatattcattaattttacgagcaatccactgaataccaacttggccgaaaattgtgatagcagtagcatttcgcaaatcatagtaacgaaaatgaatattaccaagagcaccgtaaagactgttaataagaattttacggttcagctgatttgtgttagcaagtgtagctgctttttcacattcttcaatcaaactattgagaacagattcggtgtaattcgatagttcatttaagaaatcatcactgaacttaacatatcgttcaacttcaggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgcccacgaatagtctcaggactaatgttaacctgacgaataatgctcggatacagagacgtcaagtcaaaactcataatatatcgacgagcaattggtttaggttcaaacacaaatgcacccggaaaactctgtttaacgtgcgaaccctgttgaggaataaccttatgttcacctttcaatgagttaaaaataatggcatcccaggttttaataggactcattacaccagaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgctgagcaactgattccaaagagaatgacggcaaattagtaaatgcgaatttcttatacaaatctaaataatcaagaatagatacgccatcaatagaataaatttctttgctaccgtacatattttggataagtttagattttactcgaccgattggagagaagcgtttcatactacgttcaccgagaaccattttaacgcgattcatgatatacggaacgtcaaatccctcaatattccaaccagtaaaaatagcaggtcgtttctgttcccaaagattaatatattccatgagcatatcacgctcattatcaaatggcatataaattactcggtcaagaatttcttgaggaacttcatcaccaccttcacagtcaagcttagcagctaactttgcatcccattttgatactgaaccatacattgaattcaaaaggtcgaaaacataaaaacgatcgtcaattgaatcataatgagtgatagcatcaatttcatattctgctttcattgggtcaggaaatttatcaccagtaacctcaatgtcacagttagctacacgaacaaattttcggtcataaacaatttctgaaccatatgtatcactgatataagcgagtttaaaatcgttcataccgagagcttcgagaccgatgtcttccattctcttcatccaatctcgagcatctttcattgatggaaatttttgaggagcgcagtttttaccatagatgtctttgtactttgactcttccttacaatgcctaaacatagttggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaaataaggggccgaagccccttgcttaattaccaatcgtatatttaggaacgagtttccattcatgtttttgtttaaaagaaataactcggaagttattagttaaatctttcataaaagttctttgaccagggacgatttcaatcagtccccaatcttctaacagccatgcaatcgaatcacgacgaacttcatcttcttctgtcatttcaacttgacggccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataccgcttagcaagtaacttaataatcaatacttcggtggaatcttcaactagttttgcccatttaccatatcttttaccccgaggaactgcagccattagataattaaaatgagcttcatcacttaatccagaaccgattaaattcatagcatatacagctggcatgcactctggaaattttgataatgcattttcaaccatgaattttgaataatctttttgagcaatagagcatttagttttattattaatagctccaattatttcaaaaaactcattttcagctttttctttaaaagaatcagcagcggattggacagctgtccaatcttttgaataccaagcaacttgatgctcgtttaattgaatatcatcttcaaataagctcatatcacttccactgcatttcacatgctaactgaatgaaaagataagctaaatgcaattcagtattagctgcaataccatgatactgattattttcgccgacaatttcgtacatacgaataatactctgtggagttacacgtgaatagatttcttcggcaagtttaccaacaaaccaagaataatcggctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttgcagatttcagttaatcgacgaatcatctgcttcatcatttcaattttatcttcatcagttggttgaccgaatgtaataactcgacagcgtgactgaagcggtttaataataccatcaatattgttagcagtaataataatactacagtttgagctataagcttccataaaggaacgaagatgtcgctgagactctgctaaccctgagcggtcaaattcatcaataacgattactttttgacgaccatcaaatgaagcggcgctggcaaaattagtcaaaggaccacgaacgaaatcaattttacaatctgatccattcacaaacatcatatcagcatttacatcatgacacaatgcttttgctacagttgttttacctgttcctggagaaggagaatgaagaataatatgtggaatcttacctttacttgtaatagatttaaaggtttttttatcaaaggcgggaagaatacattcatcgatagtagatggacgatatttctgttcaagaatgtgttctttttcatttacggtaatcataatttcctcattcaagttttagtgtaaatttaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgtgcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcacgagtcataataaattgaccggatttaagcataataccggagttaatagtagcgaaatttttcagcagagcagtagtatctttagacagtttcatgtaatttccttcaattcaaatgagatttaattttataactaatttaataaagcaattaacgattaaaatcagccgcaattgtttcagcaacaatttgagcagcaacaattaggcgttcatctgcattaccgcaatattcatcttcaaggcgttcaccacatgaagtcataataaatttagcaccggcgtttagggattctgcagtatgtttgcgcattagttcaatccatttattacttacttcacgatcgatagcttcataatacgcatgacgagcaggtgcagatttaattttgttctgaataacttccattgcgttatcagaaagagacaaaacccatgcgcgacgaattttattttggttttgtggatttgattcagaacgcacgtgttttggctgaatatcttttacatcaacagtataattcacggtaattttagtcataatacacctttagtcataataatcagtaacagtccaagcttcatttctgttggacattattttcgtatattctgatttaaatgcattcttaagcatagattcagtaactatatgctcttcattagaaaaattatttctcagaatatatcgttttatttcaggaatagttaatagatgctgtccagttgaatattctgccacagttcctccgtataaatatgtttatcactcgctgtatcaaaaggatatgttatgaattataaactaatttatgaaaagttaatctctaatgctaaatctcgaaaacttgattgctatactgaatctcatcacattataccgcgctgtttaaatggaagtgatgatgcttcaaacttagtagatttaacaccagaagagcactatgtagctcatcaacttttagtaaaaatttatccttctgaaccaaaattagtctatgctgctaacatgatgacagtttctacgaaatacgctaaacgcaacaataaaactttcggttggattcgtcgtaaactctgggaaatagaaaagaacaaagaattctcccaggagacacgaaagaaaatgtctgatgcagtagctaataaagcaagactaacttgtcctcattgcggtaagtctggattaagcgggaatatgaatcgttggcattttgataactgcccaaatcaccctaatcctaaagttagaccaccaatgtctaaagaacacagaaataatatctcaaacgggcttaaagcaatcgttcttgaagaaacatcctgcgaattctgcggaatgataggcaagaaatgcgttatcgcagcgcatagaaatttctgcaagaaaaatccaaatggacgcaagaaaactgaaaagactggtacttgcgtccattgcggtaaagttaccactttcggaaatttatcaaggtggcataatgataactgtaaatataaacctagctaatcttagctaaactaaatctaccaactttttccatctgaatatgctgaccatattcttgtgggtcatggtctttatgcgaaattatgaagaagttggtatccttcaaaccatctaaaattttagctacatttttaatgccttcagcatcaaatgcaccatcatacacttcatcaagaaataaacaacttattttaacacctgaaactttttcagcaatatcacgccaagtaaataaaagagcaatatcaattcgtgctttttcaccttgactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcaatgctatttcatcagcatggtcaataaactcagaagatgctttttctatagctgctttaacttttttagctttatctactgtcgtgattagagattgctttttattgcgaatatcatttgccaacgactgctgggttttaatattatctcggtattcatcaacaagaacttttaaattatcacgatgtgttgaaagctgttcaaacgaatgcgtacattcagaaactttatctttaattttagaaacaactttatcaccggaacttaattgtgacaaacaggttggacataatccgccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgaagacgagtaaggttgtcacccgttaattttttctggcgttcaacgttatcattatatattttaatttgttggataatactatcttttttaacatcaagcacttggttctgcgaatttaattcacgtattagtgctttattaagcttatccatttcagctaatgttcctacctcaagcaggtcttccacaagctttcttcgtgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccattaatggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccgaatgtgatggcttctaacatagtagacttaccaccgccatttcgtccagtaataagagttttttgaaccttatctaattgaatgtcaataggatttccacctactgacattatattttgatatctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatatttgctatgaattcatcattaatgtcaaatgtcgaaaacttcacagtatgcatccttaatacaagatacagccatatctcgtaatgatttaggtgtgtcattatctaaaatgttgaagttaaaagatacagcccaatcagtgcagaccgtgacctttttaatacaattatcttcaacctctagcggttcaaaccaatattcaataatttctttatgcccaatatcatcttttacttcacattcaaaatgctgactcatcataacatttttaaattcatcaaaagtcattgtgttgcctctacatatagctgattcgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcaccggcagttagtgtccatggtgtcccaatatatctgacattagcagcctcagaaatagtatggaagtgaccagaccacacttctttataagtcttaaggaaatcaggttcaagaccgtgagatttcattcctttataaaaataaaatccattcagttcccagtgaccaacacaaaaagaagcagaagaagtttttatgtgctcgagaatttcaccagtattttcttcacacatccaaggaatcaaatcaatcaaacacccgtcaaaatctactgtagtaggcttatcatatactttaacattaggatatttagccaaaagctcagtagaggcatttggatgcattacatttttgtagtggagatcgtgatttcctacaatagtatgtagggtaataccagcatcatcaagcatttgaactatttcacgagcaaactccatagttttatgcgtgatcgcttttcgcacatcaaaaatatcaccgtattgaatccataccgtaattccatttttcttagaatattctatcgcttgcttaattccatcaatttgaataccgcgaatccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcgcggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccattcttaataaaccaatcacgttgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataggaatcaacccacactttcatattagggtctgctcttacaataggaggattaacttctttaattgaactatcatggtattctttttcagaaattttcacgcaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgttttagaatatcccgacttttcttgatagcatattcgtattgagcaaaattattgttttcagctgcagtctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacggctgtcatagacattgtgaacgaaataactatatttctttgcaacttccttacgttcttttttaatacgttggacgaatgcattaaaacaagcttgagttatatatgcatgtgggtttttatatttcgtttcatcaaaattatgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacaatatgcttggaatactttctccatcatctttttaaattcatgaatatctatataatgactagttaaatcagcatgatataaaaagtctaaaaacttttcatgtgtgctaacgtattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattgatcaacatattcaatcaattcgccgtaattggcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcgcccttccagccttcgtacatcattgcgactgacaatgacaaggctccttcgcatgctgcatacttattattccagaaccaatttagaaaaacttcgtcctcaataccattgtgtttcatgttctggaaaaatttggcgcgttcttcacgaagcttttgcgataacatagattcaggattcatttaaattttccaattaccgttttcatcaatgaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaagtattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggtaattcatatgttaataataccacagtttgagctcgttgtaaacaactttgtgaaaattattttagggaatgataagaagggaacgatagcttagaatggtaatatacagaatgtaagaaagaaaggcccagagggcccgccttagtcttctatgatatctctatcatatccaagtgaaatgagagtttctttgaagtgtttaatgttcttttgtctagaatcattgatgaaaatgactggataacgaatgttaagagatgtgaatccagcgcgtttagcaagagatacaatcagtggacgatcatactcaatcttaccattatttgtaagaactttatagaaagtaaaaggagcattaagctcctttagaagttttgtaactgattgacatccaggacaacgacctacttcatctggaattccatagacttcaatcttattctttaagttcgagttttgttccacgagaaataattccttgataagcccagtatggcgggttaacagaatcatcgccagaattttcttcaggaaaataaacctggataacaaatccagatgcatcaaaggtaaaataaaccgtaggtaattcacctaacaattcagcgcggttattaatttcttcaagttctcgttctcgtccagcccaaaaactaggatttagactacattcatagaaataatagtcattaccgaacatatcaaaacccttccaactctctaccacatatcgctcaaaactaatcataattaggcctttttatcaagaacagcattcagtttgttagtaattttatccagacgctcattgaactcgctagaagataagcctttttctggagaaattaagctaatcacgaaaaatatagcaataaaaggaataagaaaaatagcaccaactgccataaacaaaaagaacgttacagttgtaagaaaatcagctaaacctttacgaaatttatacatattttacccttaattgattaaccaagcattgataagcactaaactatattgcgaataaaattctggaccaaaatgaaaaatcatatcatttatagtatccataatgtaattcaatttaatcatgtttccacaccccatcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttcaccagtgaatggaacaccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaatagccacatgttcttcttattgtgttcatctttttaggatcagtttctccacaaatagaacaaacaaatccgttttcagtaggagtcatttcatgggtacttccacatgtaaaacatttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaatccggttctttcagtccactgcttaagatgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcactcaagaaactgcggcaacccattggagaaacaggaatagatgagccggtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattcgcaaaagtcgttccgccgtattggtgagaagcaacttgcgcagtaatttgtgccataattgcagtagcaactccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttagtgtcagattcattatattcaaatcctctttgaagcatctcagccatcatttcctcttttcctaaacgagaaaattcctttgatttatctccaacaaagttagggtgaatattattttgggtgtaatcggattttaaataagtaagtaaattttctaaccattcaagataatcaacaccttgcccctttaagccagaacgattaaatttatgtttcatttgaccttctgcggcattgcagagattacaaagcaatccacgtacctttcctgcttttggtccatttaattcatggtcatgatcaagatgattagcttgaacatcaggatttagttctcgttggcaaattaagcatttaccgttttgtgcatcataaaatttctgtttttcttctttgtataatttgccagtcaataacataataaacccttaccttaaatagataagggtatttattattttcaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgccccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataacctttgctgtcatcaaagttccatacccataataaactgcaacttcatcacctacatataccgcgcttccgcggtaatcatgaatatagtcatttccttcgagcatcatttaaaatattctcgcagttggtcaaatccaccaatatgacttccatcaggagcaaatacctggggcattgttaagccgatttgagtatcacgacctagtttagtcagaagctcagcgattttctcatcatcaaaaacacctttttccggcataatgttgataaattcaaacggctgtttcttcacagtcaaaagacgttttgcattatcacaatacacacatttgtggatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcagtcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatacatttccactacgtccataatttttaacatcatgcggagtttataagacaacgaacgaatagttttgttgtgcttattaatttctttagctgtaatggcgccaagattacgtgagtaataataaggaacctggatattaattaatactgatgaaccacctggcttgtgtgttacttcatcagcaataacccagtccttaacatgaactgtatttgtacggtcatcgcctgcagtaaacagcttgcgagcatgcttaaaaagcatattcacttggtcattgaattgacaagcaaatttatcagcaaatttagtttcaggaatggtagataaccaatcagccaaatgggtctttttaacatcgttaacaatagtaaattcaaccaaatcagttatagatgtcgcagatttaatgaagctcggcttcataaagtttttaatgttatcacgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaattatatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgatattttgaccaaacatcggtatagctttatcatcaataacgctattgaatgatttgatatattcgttacgagtcataataatctcctcagtagaaagtaagaacattataccacatccttgtggcaaagtaaactagttcagtgcatttagtgcattgttcagtttagaacgttgcttcgtgagatttttgactttttcttgtgctttttctagcatcttttcagcttctaacacttcattggtcgctttaacgagttcatcatctactgccttaagggacttctcaatcgcatccgcgtgccatttttcaacaggtttaagactcggattttcaataggaagaaaattcactttattgaatttccatgcatctttattacctgaactatacatccaaaatttaggatcatttgacgagtaattagataaatttaagttatcttgcacttcctgctttttctcttgcgggacttcgtcctttctcaaaaaatcgtatttaaatgaaacgatcatatcaagttcatatgatgttgtatctaacttaaatcgttcaaaacgaggtaaaatcttagattgaacagcagcaacaacatccatatacttaaatgcttctgtcaactgtgatttaagacattcacaaattgaaagagaatttttagtattaggcttaaagctgattcgcgcagttcgattattttctttagatggtcttacttccatttgaagagtataaccatcaaatttcagattctttaagttaatatcagaaccttttaatcgactagccgtagacaaaatttgctttaattgtttacggaataaagcaataaatctccattcaagacgataatgatttggattataaaatcccgttgatagatcaactttactttgaccaacgccttgaacaagtagaggatttttataatcaacggttttacagaaatccatgagctgttcacgggcagtcatttgcgtaatatatccagctttatcaaaatgccgcaaccattcagcgctattcaatgagttaaagtgaatattacgtgtaactttatcagggtctaaattattttcacataaaaatgttatgacattacgagtataactagcattacgaaccatatcttcaatttgagaacgagttttcatagtattccttaaaatttaagtaaatcgataattttaattaaattttcacgctcagatttagctttactgcttaatccagacaatctaaaaatttcatcgtcatattgttgaatagaaatatttagctcttcaatttgcttattaaaataatcaatttgttcagaatgtttttcgttactacgaactggtacaggttttgtaggaaatttagttaaactggattcatccgggcgataaattaaaatgcaatttgaaccaatcgggcatttagcaccagatgaatattctaacgttccagcttcttttaaaacttcaaaagctaaacagagatgatgccccatattaacataatctgtagagcgagctctgatataataatcatcgccgcgaatactaaatttaaagcatttaaggtcttctgtattattggtcttaaaaatcatttgtttatctagacctttagctaatcgagcgcctaatgctaataatcgtcgttgattttcccacaaatctgcgatcatttggtcaaatgataatttcggcattaatcgaccataaaggtcatatcctttattataattgcgaaggatttcactcgcattaatacgagacaacgctccaattttattaagggctttcatgatgcgattagataaacccattccagacccgtttgttcgttgtaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcattcaattttttattaactaaagatttaattactgcattgacattattaattactactgacatatttcctcactcaatttcaattttactaaatacgcagaatatgatggaaaagactatataagcaccgcatacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttataagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgataaactcaatatcttcttgagttacacgagataatttagatgctttatcctttttgtactgttcgttagtatcacgagaccagtgtaatgtacgatttttattcgtatttttgtaaatttctacaataccgatctcatcgataataacgatccaattccaacgggatttgtaaatttgtcctccatcaacagtgatttcacctccgattgagatgtcattaaagaacttgctttgcgcttcagatttaaatttaccatcgttgtaatttactaagttgaaaatatctttagcgttcattttctgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatattcccaatcatttgtccatcgcatcgttgttgcgaattgaagtacagcttctttaattttagtttcgtaaatttcacgagcctttgagtataacatcattacctccatttaccagtttaattctagtcatctttttgatggcagtccatataatctatttctgaactgcctttttgtcatagaagtcctcttatgaattatttcagaagagtaacctcagcgatttcttcccaaccgtttttgtcggtcataataaagtcagcaagataaagagcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaactgagcgggacactaatgcttgtaaatgtggagcaagtttagtaccacggtctaattcgcggtcaatatcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaaagggagcccgaaggctccctatcatttataataacttcggtggttttcaagatagaccttctcaaggaagtcatcccagaaactcatgtctactttttgctgcataccgttcttagaagcttcagtagatgatgcttctacttgatcgaccacatcttccaaaaactcttgaactgttttaaatggatgcttacccaacttcacgtcgagaataaatggagcatcttggagtggataaatcaagtcgccagttttgtaaatttccaatagttggagtccaccacgacaagcatgactcaaagctttccagtcaataccttcattggcttcggccttacgagcacgttcaccatattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtgcgacgctgcttaatagaaccatcttcttggtaatcaatccactgctcagggatttgattaactactttcaatacatcacgtaatgcagccaaacgagaacctttgacaccgtatttagaagcttgcttgcggacatatcctaaatatgatttcatgttagtcgtataaaaacgagaacggttgtcttgaataaacttccacacatcaggcaaatcagatttaaccactagttcaggtggagtgtgaagcatatccaatgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgatgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaataagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatgaataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataaccttgccaacttgtaaaccattaaatgacgttttcaataaaattctgaagctttgtgtgagcatcaaccatgattttcatttcttcctttgcgaaagctgtacctctttccctagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccatcgtatgagtatccttcacaatgctcaactgctaattgatatgaatctatttcaacatcacgtgctaatttaataatttttcaaactgttcacgtgttagcatacttaaactctcgtattatgatcgataatttcatcaagaaacatatctaaagcttctacagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgtgatcaatcattctaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcacgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcgtattcacataagctattaattcgttttctttcttatcaaaccgatcagcaaattcttcttgctgatcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatattgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcaattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaagtattccactttttagcatatcgttttaacaatgtatcatttttatatctgcttgatttatctctttctccgtctttatatgcatatattaatttctgcgcaaattcagcttggcatgctttatttttcccacaataatccgcggcagtacggtttacataatctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagaggatatcgcctttcttatatcgcccttatgtatatttaaccaataagaaagttcaatgtacgcccaggaagctgaattggaccgtttattcaacattctttttatttcagcatcggtcatattataaccaagttccttaactcttgctcgcatagtaggcaaataattttggaacattccataggcatgatgctttggtttagattttaaattaactccggcagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaactttgcgttaggtttacaaactgtaaatccaagccaaagatttccatctgtgatttctaaacgtccaggacgatattcaaccccctcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacgctgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccaatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcgctcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacaggtactaataaaagcggaactaccaatggaagaattagtgttgctccaaatattgcaccagattcaatatcagtcataacgtctataaccattccagcaatcaccagaatcacaaatgatacaactaccacaggacctattaacacatcagtagaaattagctgacgctttggttcatacttcacaggtttacttggaaggtatagtgatggctttgacatattctttacattccttaacaaatttttctaataataaatcgctttcaaaattgggattttctacgaatttatcaaaaagatcatcaacaatagttaagatattctttttactaagaatacgcttattttcatattttgtttcagagtcaactataaaagtaaagaaatatttctttccctgaaattttaccgtagtatcaatataaaataaatttgatttttgtaaattacgtttaaaccatgcatcacttaaactataaacgccaagataatcataatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatacgtttaagagcatttagtaattgatctggaacatcaacctgtctttggaactcttcaaacattgaattgaaatcactttgcattttcattcctatttactccaagtaataggggccgaagccccttatcattatttcagagaattaatatattcctggacatcggcagaggtagtttcaaccccagaaatattgccgttaaaagtttcaactcgagcaagggtatcttcaatatcaaccttagtcagtgctgcaatttcaactacatcatcggcagtactaattccaagggcatttgccgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcatcaagttacaggctcataatatctcaatcatgagcctatgtaaacttatttcatattattaaaatattcttctgcgatttcgtcgttatcgtggtaaactttagaagacagtttaacataaccttcagcagtgaacatattaatcacaacctttacagtataccactgtccgtcttcattacccattactgcgtaagtttcaaacatcggatggtcaggaccgataactttaatatcattcactgtacgaccaaaatcttctgaaacgcatttcataaagaagttgaacagttcgccgtaattatccatttcattctccaagttgtttttctgtatcagtagttgatagttgtatagtaccatggaagaacagggatgtaaaccattttgtgaaaaaaatttttaaaagttttagggaattctagggagggatgggcaattaaaggataggataatatattataaagggtataaactaaatgatgcctagagaggtccagaaaggcctagataccaaaaagccctatcatttagatagggatttaaaattatttatctagtttagttattatagcttctgcagcagcttttagcttagatgcggtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccatttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtagcagcattctctatgtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttaccagaagcctttgcaaaagcagcgccagtagcaactagacttttccaggccatactaactgcatttcccgtaaatccttctgctttcatgtcgcgagcaaattggaatcgtgattcgtcagaagcatctttataggaatatttacccgctgcaatggctgcttttgcgacagcttgaatttcggtgctagatgcttcatttaacaccgcttcatttaaaaattgagcatatgatttcatcttatttcctgttttaattcgtggatttaatatactactgtatttatactaaaaagccccaacctttcggtcggggctaagccttgcggcaaccttgtcggggttccacctgctaaggcaagtgtttgtacgaaacgccgggatttgaacccggttattaagcagttgacgctactcaatatttttaaaaggccatatctcgaccatatccgaacgttccgtcaaaaacgctactcggcttacggcaaagatatttcctcgaatcgataattcggtgcgccgtttcagctgtgatagtaaagaaccagaacatagtaaaactgtgggaggaactatactccagggaacatcagtccgacgacttaccggtagcgacccggtttcttaatattcttttaaagcatcaatatgttcacggcatttacgccataaatcaattgcttcatacgcagattcagcatttcgaattggacggcatttatataaagacttgtgattttgatattgcgtagataacggaattttatctaaaaggtctttatgttcaaagtattcataaccatctaagccaaatgaacgatttttaagaaattgccaatgaccgtattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggctgacgtgataggattcgaacctataaccaatcgcttaacaggcgatcgctctgccattgagctacacatccaaattggtggggagtgatggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccatacaaggatttgaaccttggacctcctgatcccaaatcaggcgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctcaagcaagaacccttgatgatagagggtattaatcagtgcggtatgagttaataataacaaataattcttaaagcaaattaaacattttaacggtcggcaaaacaatttcttcttctatataagagtatttaacactctcaactacacgcaagaaatcatagtcataatattcagaagcatgaccaagaatatcaataaggccttcaaatatcttattaccattcacaaagaataagtcaaatacacgttcttcatcttcttcggatttattaccaaggtcaacttctatatcaaagacctttttaatgaattctggataaagttgttctgagaacagtccttcaaccaagtattcataaataaaaagcgattgctcgctgaacaagccattaccacaataacgttcagctttagtactagaatgtctgcttttaaacttctttaaaagatattggaactgtaagatttcatgctcttctacgccaaacagtgttttagttttatagttgtcaccatcattttcccaggtagtgacatcaattacgtagccctgcggaattgtagtacctaaacaaatattcatttttcaccatgctgcgttaatgtaagtatatttaatacattcaagacccaaaggattcttgaaaatatcatattcaagaagacctttttctgtttcaataaagaaatcaaaatttactgtattaaatttacggtcttccttcactaatttaacttgtgaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttatagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcagtaattttgttaaatgctacgaaattaactgattcttttccttcgtcatcaaaaacaaacacacctttaattgggcttttaccattaagatagcaaaatgcttgttccataatcgtgattacttctaatttagtcagatttaaattagtctcacgatcatagtcaattccttcaaactctttacgagttaagcaaggatagtcggtgtttgctgcaaatactccccatgcataagccaatgcatccttaataggaccagcaagttggtatttaactgcagaataattactcatgataaaatcagcagtagtatcttttccactacgctttacaccgcttaaaaagattagtttcatgtgtttctcctcaaatttaattaagattataacacacaaagctgaagcattaaacttctgctataattttaccatctttttctacttgaaaataggtgtaaggaatcgttgctgtacatactaaagccgggtctgaatcttccgtgtagctaaattctacttcagataggtcagaaacccaaggcttataaaaatttattgacatcacgatttcagttttactattatctaaaatgtaaagcgtaatgtattcaggacctgttttttgggcagtattttcgcctgtaagatagttactagttcctagcatccattcatacattcctatccacgacttaagctcttcgtcaactataaatctcacgatgagtggatcgtactcaaatgtaacacctggacgttgtgctcgaccaagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataaatgttggtggtataatgggtctaagtcccttccattcaattccaattagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccggggatatatgccttaatcatttggtctgcacccctaaatcctttcacttgactccaatcaatttttaatttagttttattagtaatagtaggtgtatttgaatattgctttaaaagctcttctagaaattgctgacgagctttaggtggaatatagtgcaagtttaatccgtacattaaattatgtttacctaaaccaaggtaaattattaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcacgcaatgtttgtctgaatgaatttatcataagcagttgtctttcttgcttattgagtttattcattggttttgattcaagcttttgaatcttttcagccgttttaattcctgaagcatattttgacattgccgaagtaaacgtagagtatttgattcctctttcttcagcaaattgctttcctgtcattccttttgctttggcctttctgtattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagattgtgctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccgcagttgtattgggttttattgatgtgtaatgataattatgatccgtattatggatggattacttcgcaagaagctgcttatcaagcatctatacaaaaatacaaaaacgtaggtggagaccaaatagtatatcatgtgaatgagaacggtgaaaaattttataatttaatatcatacgatgataatccatatgtttggtatgacaaaggcgataaagctagaaaatatcctcaatatgaaggagcacttgctgcggtcgatacgtatgaagctgctgttcttgaaaatgaaaaacttcgtcaaataaaaataatagcaaaatcagacatcaattcatttatgaacgaccttatacgtataatggagaaatcttatggaaatgataagtaataaccttaattggtttgttggtgttgttgaagatagaatggacccattaaaattaggtcgtgttcgtgttcgtgtagttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaatggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataagtgtgttactgccggccatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagcggttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgcgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaataccgagttttattttggtgaaggtgagatttctgttaatgcggcagaaggagcattgaccgctaattatattggaggtcttaaacctactcagaactctacgattgttattgaatacatcagtactaacggtgcagatgcgaacggcgcagtcggattttcatatgcagatacattaacaaatataactgtcatcaacattaatgaaaatccaaacgatgacccagattttgttggggcagatggcggcggcgatccagaagatattgaacgtattcgcgaattgggtactattaaacgcgaaacccagcaacgctgcgtaactgcgactgactatgatacattcgtttcagagagatttggttctattattcaagcagttcagacgttcactgattctactaaacctggttatgcatttattgctgctaaacctaaatcaggactatatttaactactgtacagcgcgaagatattaaaaattatctcaaagactataatttagctcctattacgccatcaattatttctcctaattacctttttattaagactaatttaaaagtcacatatgctttaaataagctgcaagaatccgaacagtggctcgaaggtcaaataattgataaaattgatcgttattataccgaagatgtagaaatttttaactcatctttcgctaaatctaagatgttgacatatgtagatgatgcagatcattctatcattggctcatccgcgacaattcaaattgttcgtgaagtacaaaacttctataaaacgcctgaagcaggtattaaatacaataatcaaataaaagaccgttctatggaatctaatacgttttcatttaattctggacgaaaggttgtaaatcctgatactggtttagaagaagatgtattatatgacgttcgcatagtatcaacagaccgaaattctaaaggaattggtaaagttattattggtccatttgcttctggcgatgttacagaaaataaaaacattcgtccatatacaggaaacgattttaacaaattagcaaattctgatggacgcgacaaatactatgttatcggtgaaataaattatccagctgatgtgatttattggaatatcgctaaaattaatttaacatctgaaaaatttgaagttcagaccattgaattatattctgacccaaccgatgatgttatctttactcgcgatggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaagacagactcgggggaaaatctcccgagtaatcaatatagatggattaacttaggatatactgcaaataacagcttcttttttgacgatgctgacccattgacatcatacattattagagtagctacagctgcacaagattttgagcagtctgattggatttataccgaagagtttgaaacttttgctacaaatgcttatacatttcaaaacatgattgaaatgcaattagctaataaattcattcaggaaaaatttactcttaataattctgactatgttaattttaataatgacactataatggctgcattgatgaatgaatcattccaattcagcccatcatatgctgatgtttcatcaataagtaattttattattggtgaaaatgagtatcatgaaatacaaggttctattcagcaagtatgtaaggatattaatcgagtttatttgatggaatcagaagggattctatatctttttgagcgttatcaacctgtagttaaagtatccaatgataaaggtcaaacctggaaagctgtaaagctcttcaatgaccgtgtaggatatcctttatctaagactgtatattaccaatctgcgagcacaacatatgttctaggatacgacaagattttctatggccgcaaatctactgatgttagatggtcagctgatgatgtcagatttagttcgcaggacataacattcgctaaacttggtgatcaacttcatttgggatttgatgttgaaatctttggtacttatgctacattacctgcaaacgtgtatcgtatagctgaagctattacttgcaccgatgattacatttacgttgtcgccagagacaaagttagatacataaaaacgagtaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacac

SEQ ID NO: 2 - DNA, 1387 bp, Artificial Sequence
  Description of Artificial Sequence: Synthetic polynucleotide
cttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggaggatacgattacggtaacgcacactccggcgctggtggtaatgctggtgctgctggtcagaatgcatggtctgacggcggtaaagttcttaaagttggtgttggtggtgcgtctggtcatgcagtgtttggatcttctccaacttggggtgttgttggaacaatttacggaccaagagtataaagaggagatatacaatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaatgtgaataaatacccttaaaaggagggtctatggcagcacctagaatatcatttagtccaagcgacatcttgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatat

SEQ ID NO: 3 - DNA, 1257 bp, Artificial Sequence
  Description of Artificial Sequence: Synthetic polynucleotide
aataatagtcattaccgaacatatcaaaacccttccaactctctaccacatatcgctcaaaactaatcataattaggcctttttatcaagaacagcattcagtttgttagtaattttatccagacgctcattgaactcgctagaagataagcctttttctggagaaattaagctaatcacgaaaaatatagcaataaaaggaataagaaaaatagcaccaactgccataaacaaaaagaacgttacagttgtaagaaaatcagctaaacctttacgaaatttatacatattttacccttaattctaagaccaggcattgataagcactaaactatattgcgaataaaattctggaccaaaatgaaaaatcatatcatttatagtatccataatgtaattcaatttacgccagaatgcgttcgcacagccgccagccggtcactccgttgatggttactcggaacagcagggagccgtcggggttgatcaggcgctcgtcgataattttgttgccgttccacagggtccctgttacagtgatctttttgccgtcgaacacggcgatgccttcatacggccgtccgaaatagtcgatcatgttcggcgtaaccccgtcgattaccagtgtgccatagtgcaggatcaccttaaagtgatgatcatccacagggtacaccaccttaaaaattttttcgatctggcccatttggtcgccgctcagaccttcatacgggatgatgacatggatgtcgatcttcagcccattttcaccgctcaggacaatcctttggatcggagttacggacaccccgagattctgaaacaaactggacacacctccctgttcaaggacttggtccaggttgtagccggctgtctgtcgccagtccccaacgaaatcttcgagtgtgaagaccattgtatatctcctctttaatcatgtttccacactccgtcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttc

SEQ ID NO: 4 - DNA, 118487 bp, Artificial Sequence
  Description of Artificial Sequence: Synthetic polynucleotide
  modified_base (4494)..(4494): a, c, t, g, unknown or other
  modified_base (4497)..(4497): a, c, t, g, unknown or other
  modified_base (12685)..(12685): a, c, t, g, unknown or other
  modified_base (61659)..(61659): a, c, t, g, unknown or other
atgtgtttccagaaaatttcttctttaactacatcatctttacgagtatcgccttgtttgcgttggatatgcaaattaaacggaatatcgttttgtaaaagccactcacgtgtcataacataatattttaacttagcattttcggtgccagattcacgtccgcttacagtaataatctcataacccgagtgatgaagcatcttcagatattgtacaaccatttcgtttggtgtatcggttgataatttatctaattcgtatgggccacgagatgtatgaatagctagtgttccatcaaggtcaaagattgcagcttttggtttaccaggagtccctttgtataccggaagaccgagatactctcgcatacttttatacattgagcgtaaaacatcaattggtactgctttagttccacgttttgagttacgtttaaccaattcagtccaaggaacatcaaacactttatattcaactttccatccgtattctttggcaaaagtttcccatgctaggcgacgttcaggattcaagttagtgtctgaaataattactcccttgacagaatcaccgccgtacagaatactcttcgcggtatcaaactgcataccggtcacaatgccttctttctttttggtatacttgtactcgtcacgttcttcatgacccatgatggattgacgataatcatcacgattgatattataaaatccaggatttttagcaataaattcacgagcccaagtgctcttacctgaaccaggacagccaatagttaaaataatctttttcatcatttaattcctaagaaaacttcaagaatacgaatattatgctcacgtcgctctttatacacttcagctgttgattgattcactgatttgctctgaacattagatgaaataaattttatcatgtgatttttaagctgatacatatcaagtccacgagcttttgcttcttttcgtagagctttaccagcgtcatctaaagctttcgtagggtcttcatcatttaatactattccacgatccaaatccatgtatactgcaccatgacatgcatcaatgtaaaggtctgagcattcaatataacgttctaacagagttttcatttatttttctcaactaatgattgaatataatcatgcaggtctttagatgctttaccccacttattttgatattcatttttgagattagcacgggattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatgacataccgacccaagctttaccatcaataactttaacttgccaagatagtttagcttcatcatatgactttatctgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaataaacacttcacaatcatacttagcgagttgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgtaaatccatcataaagtcctcatgttatgtcagtaagtctactataacacaacacgaggggtttgtaaacagcttagtatccttctgggataaattttttataatttttcaaaaaattctgttcgatttcacacatgaccttttcttgactatcgtacccctggtataagctcatgatgataccgaacagatgttccattccagcacctttagcaacgccttgcgcttccattgcataagtctttctatccttaccacaatgtttattgtgacagtcaagaactaaaaacagagctcggtctaagtacttcagataagtcgtttcaaacgcctcaatttttctgtatgaatattcatcatcagcgtacattgctttaagatcatctgatgcaccatcaataatagtcttaaacagtttttctggattgtctaatgagctttttgtactatgaagagacacgtaccagtcagacttaattttaaaatgagaaccatctttcatcacagcaacatagccttcgatgttttccgcatttttagcttcttctacccatttagggctatcgatttcgtatcgttcaactagatatggacgaagaacagcatctttataaatgtcatcatatgaaatgtattcacctgtttcattttcacgaatattcaataaaatgattttcacctcttgataagcaagaacgattctattagttggagcgacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcatctggaagtaaccaatcagaataagatgcataattatatgagaaaattctgtaagttcttccagatgcacttacatcatctgagtaaaaaaacttacgctgtgaatccttacatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgcggcgcggattgaacattatcagaattaaggtattcacgaatccaaggatatggatgtttaaccggagcaccggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgntcncactctttggcaattttaacccattcatcaccatcagtgccaagttgaagttgacgaataatatattgtgtacctttaaggtggagttgctcatcacgcgcaataaatttcataatcttcgcgttaccttccatgatttccatattcttatggaagttgaaagtacatgcaaaagatacataaaaacggatagcttccagggcattgataacgtgcaagcagagataaagcgacttcatcaggtcacgtttacaacctgcaacatggtcaatagcgtcttggacaagttcttcatcatgctctgttgccaggtagaattctacgtcagctttagcgttttcccattcacgagtctttaccagaacatcatcataataacgaccaatcgattcagcacgtttcatgattgcatcatcaagaataatctcatcaaataccttggcagggtcattgaacaggttacgcatgatgtgagtataagaacgtgagtgaatagtttcactgaatgtccaagttgcagtccatgtatctaatgacgggtcagaaatcaatggcatcagtactgctgcaggagcacgtccttgaatactatctaacaatgactgatatttcaggttgttagtaaaaatattttgctgatactgaggaagcttattaaactgtgcagcatccatcatcaagtttacttcttcaggacgccagaaaaatgataattgcttttcggttaaatcttcaaaaactttatgacgttgaatatcataacgtgcaataccaagacctgaaccaaaaaacataggttcttttaaaacatcaactggatttgtattaaaaactgtgctcataaattttccacttagttaatagttggtgactcgtccatgagtcaaattatatcataatttacaggatgaacaatcttcagcttttggagtttctatttcataatcatcagtaccagaaccgtcacgggtattatgataatagaaattttttccgccaaaataccagaaatacaaaaggtcatcaatcattattgacattggaaccttgcctttagggaagatttgggggtcatagtatgtattcgctgaagctgattgacatacccatttcagcataatagctacctgcgtaagataaggtttattacctttcttagctaatttccatgtataatcatataagtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcacaaggtcctttttctttggcgagcttaatggatgctttaatgagtccatactgtaatctctcaaatagttcatgtgttaaatcgttagcatcttcataagaagcaaagttacttgccaaccaagctgcatagttagtaacacctacgccgaggttacgacgctttttagctttttctgcttcaggaactggatatccttggtaatccaaaagattatcaagagcacgaacctggacttctgccaattcattaattttatcttggtcttgccagtcaaaattatccagtacgaatgcagagagagtacacaatccaatttcagcatcaggactattcacatcatttgttggaatagcaatttcacagcacaagttactctgacgaatagatgccttttcacgaataaacggagtatagttattcgtattatcaatgaactgcacataaatccttgctgttcctgaacgttcagtcatgagcaattcaaatagttcacgggctttaatacgctttttacgaatattagggtctttttctgctgcttcgtataattcacggaaacggtcttggtctttaaaataagaataatacagctctccacccatttcatgcggactgaacaaagtaatgtaatcgttctttccgaatcgttccatcatcaaatcattcagctgaacaccataatccatatgacgaatgcggttttcttctacgcctttgttatttttcaaaacgagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcggaagccttattgatagacttcaatgaatctcctgcctcaataacaacgcatgaactgaactgtcgagtcggagtacggcaaccagccataataggagttggcagtgaaatctgtcgagtagatactgcttcataaaaacgaataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgttcgtgcttaatttttgattctaaaaatgtaatttcttctgctgaatattttgacaataattcggggtcatatttaccttcatttacacagtaagaaatatggtcaataaatgaacgtggttcatattgcccgtaaacatgcttacgaagagcaaacattaaacagcgtgcagctacgtattgataatcaggctcttcaactgaaatagaattcgcagcagccttaatgacaatagtctgaatgtcatcagtggtcattccatcacggagatatgatttaatattttcatataattcataaggatctacagatgttccttcagctgcccaagataaaactttaataattttttgtggatcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaacgacaccagaagtatctttaaatcgtaaaatcatatatcctcgcaattaaattaaaattataccgccatttttcctttcaagacaccgtgggactgataatctttgagaacgaaatctttaggcctgagtttaagaatatattccaattgttctttagtagaaagataacggaatttataaggcaatccgcctattaccagttcacaaagctctttaggttcacgacgtaaaatttctttacattgttctacgtgattcatatagatatgagtattaccgccagaaaatatcaaatctccaggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcgtcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatatatttaagttcagctggattccatgctgaaacaatttgacgcctatcatttggcagttttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccatattagctcagcaatgcaagctttccaggcgagcttcttagttgttactgcaggaaaacctttagttaaatcccagcgtaatttagtaccgaacaaagcaattgttcctgtgcctgttcggtcatcggttttgtagccattttccaggatatctttaattaaaaattggtattgtttcattagttcatccaagaatatgtagaaggatatttggcaaagttaggcttatatcctaatttaaccatttgttttgctttgcgagtaaatcctaaagaacgctcacctttaagatattgttttggtgtcataggcccttgatgcatctgcctacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcgtctaattgaaccgttgaattaacacgatgccttttaacgatgcgagaaacaactacttcatctgcataaggtaacgcagcatataacagagcaggcccgccaattacacttactttagaattctggtcaagcatagtctcgaatggtacattagggcttgacacttgaatttcgccgccagaaatgtaagttatatattgctcccaagtaatatagaaatgtgctaaatcgccgtctttagttacaggataatcacgctcaaggtcacacaccacaatatggctacgaccgggaagtaatgtagataatgactggaacgttttagcacccataatcataattgtaccttcggtacgagctttaaaattctggaggtcctttttaattcgtccccatggtaaaccatcacctaaaccgaatgctaattcattaaagccttcgaccgttttagttggagaataagcgaataccaatttaatcattacgcaaaacccctttcaataaaccattcagtggctttattagcatcaaagaataattcttcatacgtcttttctttgttttcaaaaactgtcacacaaacacgttgacattctccacagtattcttctgacatgctcaaagcgtcagaaaacatttcgttaaattcacttaaatcaggattatgcaatgcgttaaaaattgcataatcgaattcatcattcataaattcaaatacaaaaatcatattacctcccactgaaaggggccagaagcaaatccgctatctttaatcattttaactaaagttaccattcctttgttaactgcttgtgcgatttcatcaaaaacttcatcgctatcatcataaaggtcattaaaaagttctaacacgttcttctgaacttttaatttatgaccaacaatctcgcctacagtaaattcgtttccgccgattccagtgtaaaacgtaattacaccagttaacagactttcgcgagaatctaggtcatgtgataaattaatataagccatcccgggtgcagttttaagttggcaacgaattcttacttgggtaattccggttacatgaatgacggacatattattttcctcaaatagactttttcacaattttccaatcagctttaaactgatcaacgtcagaatgataaatccagaatcctgcgctttctccatcctcataaagagggcatctatcacattcatcttcccatcccatatcacgcaaaagatgttcagctttttcaacaagcccagaatctttaccgatgatattaaaataccatttacctttaacttctgaatctttgatgctctggcgttgtaatctcattttattctccttagcaagctttaatcaaaagatataaacagaccaacataactgctgccataatataaggtgcgaacattttcttttctccattagttttgatagggtaatagtattatcacactactaccctgttgtaaactactttttgaaagtttttcgcaaaagttcaatgatttcatctacattattttcgtcaacaatgcagtgaatttttgttacgccagaaaccttgtctttaacttcatcctcttcagaagtaggttctttatattcgtggaaacaatgaaattcgtcttcacaaacgttaaagtaaaaatgctttccatttgcgcattcaatgtgttttattactctaaatccatcaacaaagaaagcttctttaacttcaaaccatccaccattttcttgaataattttaactattgatgaattagaacgtgggcgataattaataaatgtatcaataagtcttggaacaagctcatactttttgccaatatacattacgttttcctcattttaacggggcttgtaatagccccttgataattattgttcaatcaatcccatgtaaaattctgcgtcttcagaatccataccatcacaatattcattagccataaagcgggtgaggtcttcaagaggaccttcaatgacaatagaaaaattgcaataattgggatcatcgtgaatacttgtgatactaagttcaggataacgattacgaataatttcttcaatatattcaaaatcaacgatgtcaatatcaactttagccatattattttcctctttaattatcagcagtattgccgatagttgtatagtaccatggaaggacaaggatgtaaaccgttttatgaaaaatttttgaaataaaaaaggggacctctagggtccccaattaattagtaatataatctattaaaggtcattcaaaaggtcatccaggtcngtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttactacaagaatgttagcccagtaagaagttttacgtttaacaagactgtactctttattgtcagtgttgtacagatcatttttactgatatactgacatactggacaagaatcgtaatcaccgtaggtagatgagcatgtttcgatataccatttaccatttttcttgaaaccgtgatttacaagaagtgcgaatggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgcagaagtttaaaaatataacttgactgaacctttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcttggttagcaaccagattgcttataaagattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatatatctttcaccaacagcaggcatgcggagtttaatcatagtagaaaatctaatgtattagttttttcacaacgaacaacagaaggacgtaaaagattttcgtcaatagcttctgactgaattttttcaattatacccgaaggaataaatttagcaaattgagtttcaggaatagaattttcttctaagaatgctgttgtagcttcgagataactcattccaaactcttctaccattttttcaataataaatccattttcttggcggtcaagaagctttgcaatttcatccttttctttcttaattgaaagttctttttctgaaagaccggtctcatcgaccggacgaatatcatttagagaaaactgtgtcataaagttcaactacctcttcagtttcagcttcaaacacatcacggttatctttatgatacaaagctaacagacgattaaacatcttgccatcaacaccaagttcatctttggcacgaattcgaatatctttaatcaattcattataaccagaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccgcgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacaatagaggttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttgtgcatcggtgaccattgcttaacatttgggtatttgtgaagttgagtaaagtcaccatccgacgaaatgattaaaatcttatgtccttctaaagagaactttttaacaagaacagcgatatgatcatctgcttcatacttatcaatatccataacgatgtatggcatataagctttcaattcatctataactttatggctggattcaaaataaccttcccagtcccaagtagattcttctcgtgcttttccgcggtttttcttataataataagcgaaatcacggcgccagtatccagatttcgcgttatcaatacacagcacaattttagtgtatccaagagtttttgcttttttgacattaaacttaattgagttcaatatcaaatgacgaaccattgataaattaattttttctttatctgggaagtttacaagagcagttgaaagcgcaatttgactaaagtcaataaagcaaattccttctttataatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggtgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttggtcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataaccgtttgtggcaaatgtatatttctgattatagcagagaagctgcaattgttactccatcgactgcatatcaagcacaatctaatgattttatcgtacgtagatttacttctgccgcaccgattaatgttaaacttccaagatttgccaatcatggagatatcattaatttcgttgatttagataaattaaatccactttatcatacaattgttacgacatatgatgaaacgacgtcagtgcaagaagttggaactcattccattgaaggccgtacatcgattgacggtttcttgatgtttgatgataatgagaaattgtggagattgtttgacggggatagtaaagcacgtttacgcattataacgactaattcaaacattcgtccaaatgaagaagttatggtatttggtgcgaataatggaacaacccaaacaattgaacttcagcttccgactgatatttctgttggtgatactgttaaaatttccatgaattacatgagaaaaggacaaacagttaaaatcaaagctgccggtgaagataaaattgcttcttcagttcaattgctgcaattcccaaaacgttcagaatatccgcctgaagctgaatgggtaacagttcaagaattagtttttaatggtgaaactaattatgttccagttttacaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtagctgaaattgctacgcagcaggaaactaatacaggtactgatgatactacaatcatcactcctaaaaagcttcaagctcgtcaaggttccgaatcattatctggtattgtaacttttgtatctaccacaggagctactccagcttctagtcgtgaattaaatggtacaaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacgcaaagtgaagttaatacaggaactgattatactcgcgcagtcactcctaaaactttaaatgaccgtaaagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattggataatgttctaataactcctaaaaagcttttaggtactaaatctactgaagcgcaagaaggtgttattaaagttgcaactcagtctgaaactgtgactggaacgtcagcaaatactgctgtatctccaaaaaatttaaaatggattgcgcagagtgaacctacttgggcagcgactactgcgataagaggttttgttaaaacttcgtctggttcaattacattcgttggtaatgatacagctggttcaacacagccattagaatcatatgagaaaaatggttatgcagtatcaccatatgaattaaatcgcgtattagcaaattatttgccattaaaagcaaaagccgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactacatcgggtgatcagactggtggatttaatggattacgtccattgtccattaataatcaatctgggcaggtcacaattggtgaaagcttgatcattgctaaaggtgctactataaattcaggtggtttaactgttaactcgagaattcgttctcagggcactaaaacatctgatttatacacccgcgctccaacatctgatactgtaggattctggtcaatcgatattaatgattcagccacttataaccagttcccggggtattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcgggaccatatgttaaatttcaggataatcccgttggaaatcaaacatttagcgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatatgaaagtgtcgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgcccaagcaggtcaaggcggcatgagaaatttaagcttttctgaagtatcaagaaatggcggcatttcaaaacctgccgaatttggcgtcaacggtattcgcgttaattatgtctgcgaatcggcttcacctccagatataatggtacttcctacacaagcctcttctaaaactggcaaagtgtttgggcaagaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaaccacaggcagctgataacgatttcgtttctaaagctaatggtggtacttacaccggtccaattactattaattacggggtaaatagttatcttcaattaagtaataatgaaacccccattcgaattcgttctggtggcggtaccggtaatactcttgtagttggcggctcttccggcggtattagttttagacctgcaggtagtgaaatcactactggacaaattactattacaccagaaggtttgacaacatttaccagggctgtaacggctccatcgataactgttacatctactccttccgcagcatctgatgttactcgtaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctattaatttaaaagataaaacaattttcacaaaagatgactcaggcaatgttatagaattaggtttaaaatatggaggaactataaatggatctttagaggttacagaaaatataactggaactttaattggaaattctagtacagctactaaattgcaaacacctaggaaaattaatggtatatcttttgatggatcaaaggacattacactaactccatctgatataaatgtaaatagtacaacatttataaaaaataacggcgaattacccgttgatgctaatttagatacatacgggcccattgaagaatatcttggtgtttggtcgaaatctacttcaacaaatgcgcaaccagcaaataaattcccagaagaaaatgccgtaggtgtactagaagtatttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggagaaacagttcaagagcaatcgcatcatttgatcgccattatccagaagaaggatcagccgcacaaggatttttagaaatatttgaaggtggtttatacacaagaacgcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcctgggttatataatattttaggcactgatgccgttattaactgtcctaccggtgaaggtttgccgactgttattgttggtttgctggaagttaaacaacgtgcttctggcggtgctattttccaaaaatttactactgccggaacgggtgcaactactcgcgatcgtatttttgagcgtgcatatactggtggtgtgtggggtacatggaacgaagtatatacatcttactctttgccaattactttgggtatgggtggtattaaagcccaattagcggagctagattggcaaacatttgattttgttcctggtagtatgtttagcgttcctttgaacaaaataaagaacatgccagcaaatatgaattggggtacaattgacggaaacttagttatgttttctgtcggtcctagcgaacacaccagcacaggacgtactgttcaggtttggcgtggtactgtatccaagacaaactaccgttattttgtcgttcgtgtgttcggtaattctggaaatagaacttgcacagttcgccgtgttgttcttgaagacggatcacatacttggactgctcaacaagattttaatggtgctgttaactttggtagttcaacaacgtttaaatcaactacaacatttaatacagaagttaaatttcgctcattgaatgcattccgtatgtatggcggaaaatttggtacatttttacgtaatgatggagagagtctttatattctttccaccgacgaagatgatcaagatggaaactttaatacaaatagacctttccgttatgaattaagaactggtgatgttactttgggtggtgctagtggtgctaacgttttaaaattaaaacgtgattctctcaccgcattttttggcggtgatattaacattaaaggcacgatgacttttgacgccggacgtttaggatcacgagattattttaaatttaaccattggggtgatagtaataatgcgcgtgataatatcatccagttagaagacagcaaaggcgctcatttttccactgaacgtactttagcgactggtgcaattaagactaaattttttggtgaaattgaatccgatggtaaattggttattaaacgtccgggtgattctattgtattatcaacaactgctagtaattctttgcatattcgcggtgatatagacgggactggtaactggtatattggtaaaggtggtgctgataatggattagcgttctatagttatgctactaatgctggtgtatacattacaaacggaggggatatcgcgctaagtccaaagggtgccgaaatggctcaggtcaataacgttcgattatatgttcatggtgaacgttggactgctagtcaaccaggtgattggggtcgtcagtggcaagtggaagcgccaatattcgtcgatcatggttatgttggaccagatagctattatccaattattaaaggaagaagtgtaatcaccaatcaagggtttgtaactgccgtcgatcttggtattcgtcgtgtcaataacaattggggacaagcaattattcgtgttggatctgcggaggcatcgccagcggctggacaccctaacgcgatatttgaatttcattacgacggtactttctattctcctggtaatggtaactttaacgatgtgtatattcgttccgatggtcgacttaagatcaataaagaagagttagaaaacggagcacttgaaaaagtatgccgactgaaagtttatacatacgataaggttaagtctattaaagatcgtagtgttattaaacgtgaagttggtattattgctcaggatcttgaaaaagaattatcagaagctgtatctaaagttgaagttgatggatctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagaaaattatggcagtagttggtgttcccggttggattggaagttcatccgtaaatgaaacaggacaacgatggatgagtcaagcagctggtcaattaagattgggtgttccttgctggatgagccaattcgccggacgctcaagagagattattcatactgtaagtgctaatcataattttaatggtcagtggttccgtgatagatgctttgaagctggcggtgcacccattgtattcaatattgttggtgatatcgtttcttattctaaagatgttcctttattcttcatgtacggggatacgcctaatgaatatgttgttcttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggaggatacgattacggtaacgcacactccggcgctggtggtaatgctggtgctgctggtcagaatgcatggtctgacggcggtaaagttcttaaagttggtgttggtggtgcgtctggtcatgcagtgtttggatcttctccaacttggggtgttgttggaacaatttacggaccaagagtataaagaggagatatacaatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaatgtgaataaatacccttaaaaggagggtctatggcagcacctagaatatcatttagtccaagcgacatcttgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtattggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctatgaattccttgaacgactcgcgttcctgagctacattatgctcgattaccttttcaagattatgactcattcgaaataatcttcaatttcgtaatcatggacataaatcattatagtttctaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcgcgtgtatcggtatatcccatctcaacaataaaatgccgtattagatttttatctttatcgttgagagaattaaaataatcggattttgaattaatttccctggccaatttgaatcaccttcagttggcgttttagctcttttatcatctcttcgttcatcgcaatataaagatcgcgtaaagcaagttttagcattccatttactggataactaaatggacatacataatcttttcctacgagctttttggtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaagataaatttcgtaagctgaatccataaaggaacttatagctgccatgaaattattgcgaatacctactggagcatctttactttcacgaataatcatgtatttgccagtcttaatctttacaatagttccaagataagccccatggtaccagatgtcccacccctcctgagtgggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactacgataagtttcaacctttttaagaacaaatccattttcatctaaaagttttaacatgaagtctttatcttcttccatatcagaagtaatctcgcgagctttacgagttgctcgttttttcagcagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttctaatctccgtaattctgtatcagtagttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagtttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatgacgttcttcttcattatcgctcaaagaatattctttgcggaatttaactttgaatccaaaaccatgctcaccgcaagcatcatcccatgtaatgaagcctttatcttcaagtgggtctaagattttactcacgtaagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgtaatacagctttcttaacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatatacgttatagaaatttttacttacacgagcaaaaatataacgacttgctgctgctttttggacggtacgagaaccaaagtttccttgaccatctaacagaggaaaattattattccaagtgttagccatcaaagcacctgcgtcttgcgcagagttttcaccatgatgatatccaaggtccgctacaccacctgcaatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctactaataaagcagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttgtttttaagattgttacgatagaactgcatcacatgttcgttatggaaattactcatacacaccacacattttgcataaacgttcaaaacagataaatccgccacctacacacatcacgacagccacattatcattaagaggtagacctaaagccgtaaagattccagtcaatgtgaataaggctaaaactaataggtaacccattacaaatagagctttcattagtatgcctgcaaaacaaatttaaagttatcagccaacatacggttcatttcttcaagtgtttgatactcagaatgatgattacgagtaaacgctaaagctaactgaccttttccaaatcctgtcgtcaaaggtttcatcttagaagcaggaagataaaatactgcatatggaacattgttatttgcaatagtacgcgcaagctgagaccgacgttgacgaatatgacttagaactgcgctgaatccttgcttagaacgttgattacctacataaaatcgtgcagacacacatggattactaaatggacgaccatctaatttacttactaaaaagtaaaatccaggtttagataaaatatctttatgcggagttcccaaaaaccactcaccacccttgattgtaccaataacagtagcacctgcatcattcagatcagtaacagtcatatatttcatattaatttcctctaaattattttctactccaaggccgcatgaatacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagttgatagggtaatagtaccacggaagaacagtcttgtaaacaactttttaaaaatattcgtaataaatgtgaataccaatcaccactgctgaaacctgtgcaacccaccacgcacaagcaataagtacagaattcaaaattttcataataacctcatcacaaaagtaaatgttaaacaaattaatggaatactaattaaccaaacgaaacaccaccataatgaactcatagttcaatctcagcaattttcatttcattactattaatagccgctttaagactatctgaaagaattacattccagtggtcattcatatgaccattaactaagcgtgtaatttcttcgggagttgaaaaataaggcgtatcagactcccaatgcgataatcctaagcgagtataaatcataccttcatcatcgctagaatattcaactgacacaaactcatcagttattttatgtttagcgtaataaaatttaaatttcattttccgctcctccgtagttgatagttgtatattaccacggtccttgtggtatgtaaaccgttttgtgaaaatttttaaatggaaagataccatccgttgtagttgctttttcttacaaccttacgaaggtcttctctgtcaccgatgaacttcggagtgtactggatgacacctgggtgaatttctttagtgttgaatataattatacagtcagcgacctgatgattcagaatgggccctagatttattccagaaccatatggatactctccgctgcatcctgttgttacagaaatccaacgtgagtcagtttgatgtgtcttaacttctacacgaagcccgcagtatcttggatgcgccaatacatcccatgcgtatgtatacgggtcattaacgtcctcttggcctttgttaacatacccgcttagccaatctgctacaaaaaactctgcgtacaccgcgatacggcatctttcgataacttctgccttatcctgatttgggttttgttttaaagagtatcttgctgtatcagcaattttgaccttcatttcactagtcaaatcactgttcgatagggtaaatgtcggaatctgaaatagtctctgtaaacccggattcgttttctgcatttagactttcctttttaccgctgagataagcgttatatactttaagagtgccgtaataaattcggtcattttcatctaaagactcacggtcaagttcatcgagttcctttttatccatgactataacatcattgcaataaagaaacccaagttttttgtgtccaaactcaaatttattacagtacacaatattagcgtgatgattaccatgtagagaaatttcttttatgtcggaatcaccgatattcatacaataaatcataattcaccttaaaacaaaagggccgaagcccttattttatttgaattgtgcaattcttttctctaaacagtcagcataagatttcattgagataaactgcgaaagtaacagttcttgctcaactgcactaactgttagaaactttgcgctttctaaaaatttgctcagtgcattaattttgagcattaattgatcgtattcttcttttactcgtgcttgataacctaacataattttccttagttaagggccgaagcccttatttaaattgttcagtaacgtcttcaactacttcgtattgacaggtacgcattttagcatcgttgtaatcaatcggaattgatactacatcacgcggatgtactttaacttttacaactcggctggttgaactgccaaagtgacgaatataagatttagaacacacatgcagaccgcgagaacaagtttgtgtatcatcgtcattcacacgagtacgtggcattttaactactttaccaggactgttatcaaaagtatttgaatgacagtcaaagtagttgtcacgaactactttccaagcatagaagtaaccatcttcggtgatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccagcttatccgctacaagcagattgagaatttcctggaagtttgaatgagtattaggtgttgcgttataagttacaccgtcaacagtaattgaaatgaattttttagatgcattccaaataatgtcagatttagcaactggagcaataactgcatcgctattaactttaactgtaatatcaccgctaatagtaactttagagcgtttagcttcttcagcatttttcaaaacacgacgaattgtgtcaaccgatacaccttgccaatcagccaattcctgttgggtgtaattaccacttgaatacaatttaacaatttcagcttgttcgtttttggtcaggcatttaatattgtacataattttccttattaggccgcaagggccttcatagttttagcgatttgggaaacttcatcatcatttaaagagttgcgataaccgatgaagtcggaaacaatacggaatttcttggtaaactcagcaaccattttatcactattttttgaagcattacgtgataattcatcaaagagattagttactgtccagatatcatgaccgatggtatcttttccaccattgaaatacacaccgcgtaatgaactaaccatattaccaagtcgtgtatattcttcagaaacttcgtctgtactgaagtacttcatcataaaatctagttcaggatacttgataattttatcaatatatcgttgagctgaacttgaataacctacatacttatcataatctacatcatcaaaagcatctacatataaatcacgcagagtttcaaaaatacattggcactgaccgagttcttttacctttttctgcaaaagcggacgaataacataaaattcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgctcattgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatgactttgcttaatgcgtttcagtcgagggtcaagatttacttcatacaccacgcctgcattgcataacttactatcaggttcaaacatactctgcatcttcttatatgacagatttttagtcgtgaatttgactgaattactaatcatataatctcgagcagaataccccatcttcattaattcgcgatatgtatgacgaggagatgtagattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccgttaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcagtcataatagcaatattatgataattcaagttttcagctttttcaccgagaactaatccagtgattgcgcaaatatcaaacaattctttgtttttaagcatatcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcattagaattgcttcattatttagaatagcacgtgaaatctttttagcatcaagttgaatatgactacggatttcgccaaatggagaagtcaaacgctctttagtttgagaatcaaatcgcatgtttttcatatcacggacaaacataacgatagtcaaacattctttaacgcgtgctttagtcacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagagcaattttcttgttcttgaacaatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacggatagtcgaatccttgaagaatagaccagaacacacggttccttctactttctgcccagtaggtccaatagcacgaaatccagtatgttggaaatcattttcagagcaaccgaaccagttgtatccagtgatttcaatattagtaaaaccacttgaagataaaactttggttgcattatcagcatcagtacatcctgctaaagacactgctaatactaatgctgcgatagaacgattaatatatttcatagttttcacttaaatttaatggcttgaaggagactaataattctcaagcgacttctttcatctttaaccgtaaatgaaagagggtcaccagatttcatagtgatagtgcattcaaaatcaaaaccttcggggacttcttcgaataggtcaaattcttcatcatatattagaacattactctgaaaactgtgaagaatttttccatcatttccagatgctgtactaatcattgtaacattattacctttcatatcttcaacgataaattcgcttgtagatattacggcattaatagaaccattcctataaatagcagaaaatagatatttcttttcttcaccttcgcgaatgcgatatttcttaccaattttaaacataattaccctttaagtaagtcgtaaaaaccaccattcacatgcttaggagcggaaactaaccgaatagcaatccgatgacaatcaggacatacatcagtatccctttcagaaattttcttgattttttcgtattcttttgcacagtctttggattgacatttataatcataaagcggcataattattccttaaagtgtgctttcaacatctgatacaaggaccatgcttgttcattattttcaatagtaacgttcataaccgggaattcagatggatcagttattgttgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttagaagataattcttcccgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacatgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcagaatatctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccatcgatggtgcttacatcttcatctgatggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttccttgctaaatcgcgaatttgacctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataaccgccttataaagatggctaatttcacctaaaatgtaatcactgattgtaacagtttttacttcaccacaaaagaattctaacgcaatcaaatctcgttcaatttcttccaattgaagcattaacttgcctgattcaattttcacgtttttgcgatttttactataagctatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatagcctcacacataaaacacatcataacgaccacgggtaacaccaacataaagaagttgttgggccaattcagcatctgcataatgaatacaaggcgtataaatgaaagcacggtctacagacataccctgagctttatggaatgttgatgcaggaagtgctttcactttactaaactgtgatttagcatcccaaaaatcactccatggagcttttccgcctttgttccaatttttataagtttctgctgttttacctaaaaatagattaaacttatataactcttcatcagatgaaattattttaatcttttcacgataatattcatcatcgccgtaagtttctactgttaaatcccaatgacgaattagatattccccaggaacaccacgagctttaacaaacgttgatgtatactcagcttctataatacgaactaattgtccgttattaaaaataatttctgatacaggctttccatcaattttatatgttttaattaatggttcctgcattacaataatttcaccaacaataaaatctttatcagtttcaaaaatctttttacgaataatgctatttaacttatcaacagatttattcgtaaatgccattacgcgattttcaaacaaatcatctagtgatttgacgattgaaaaataatttaccataaaatcgcgtaaagcggtatcaccggtaaatccacgtactccatgcccgtcaacaactttatcataaatccacttaccgttacgaacatcagtagctacatcaataataggagcattactgcgtttaacttcagtaagttcacactgataaaaatctttgtgtgtaaagaatggactgatataagcagtattttctcctgggtcaacaggtctaatttgcttattatcacctattccaattatggtacaccatggcgggatagttgaaagcagaattttaaatagctttctatcatacattgacacttcgtcgcagattaatactctgcatttagctaaatccggtacttctttttgttcaaaaagaacgttttcttcatatgttactgggttaattttaagaatgctatgaatagtacttgcttctttccctgatagttttgaaagaatctttttagccgcatgagtaggagctgctaaaataataccagtttcacccgtagatattaaagcttcaatgatgaacttagtaagagtagtcttaccggtaccggcaggtccattaatagttacatggtgtttcttttctttaatagccttcataacaatgttaaaggcatttttctggccttcggtcaaatcatcaaatgtcatcgtaaattccctgcaattggtatactaacaatacgcccagtatctaaaattcgctgatataatctttgtgtgtctacgtcgggcttaacatgtttaacttctattttattaaaccaaaacttgcgtggagtctcaactaatcttggaattcccttacctaaagctaatcgatactgctctttaagagtggtaaatactttatcagcaatcttccattcaaaaaatacagcaggacgatgttcatcaagtggaactggcgcaataaatccatctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataatccttagcttaatgtcagaggtttgttttgatttagaaagctgtgaaatgtgttcaattcggttttcacgttttttctgtatagctttaatttgattataggtctttttgattttagcccatttcttttcatctaaatttagtttatgaacttttttcgcagatgaacgaccaattcgcaaagcaaataaatcacgcttttcaatcaactcctctaaagtataatcagaacgaaatgtattatactttttctttactgcaataacattccctttaatgtatccaatgttattatcaaaacgttctaatgataatttctctccttcaatacgattatcaaaaggttctcctgagtaagcgcaaactttctgatctaaaatgttcttaatgtaattgaagtctaagttaaaatctttagaacgtcttttagcagatgcctgagtgtgctctaaacgacgtttaattttacgaatttgattattagacagtttcatatttttctcacatcttacggacgatttaatacttactataacatttttacttcagattgtaaacaactttatgcaaaaatgctttaaaaatttcatggtataatgaatctaagtccttccattatagattaaatccttcaaagtcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgtagagcttttatagcatactcctggaaattgaataccataggagctttgaattcaaaaataacctgtgtgttatactctaaaccggaagcaaaatgtatagctatatttttatcatatgaagctgatacgactttatcaaatgtaataatatcaattccttgatttaacgcttgcttagtctcgactggaacacctctccaaagaggtttatcgtttggaaccaaacgagatttgactatttcatttaaccaagaatgatcgtctggtttattagtaatacaatgaattaaaagttcaatttcagataaattaaatccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattttatactttccaattggaatcatccattcttgttcacgtacaatcatcattaagttatcagtacgttctgaatctaatccatcagtatcttcatatgtatacttaaattcagtattaggagaagaaagtataatatcgctgatatggtcagaataattaaaagctttatcagtttttaagcgaaatattatttcagtgaaatactcaacataagaaaaaccacatgctgtgcgcaaactagtagtaaatgaatctactctgttcgttgaaaacacttctccaacttgtaaatctttaatgagttcttttgtcgattttgatataccacgatatagctgataaggcgatttagttaaatgctttttaactattttattcaactgccgatgaagagcttcattctttttggcttccatacactgccaaagaactgactgttcaaagtcagtaaatttttcacagacctttttgtacatatcatattgaaaatcgacactttcagcttttatagataactgttcaacatctgcgagattaataatcatgatagcctccatatacttcagaagctatcatatcattgttaggaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaataacgattagcttcaataatctttctttcttcttcagatattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcaacactaatcattgatttcatccattcttccgattcgttctgcatttctttatttgcttgttcaacccaaccatcatcaatatacatcgagtttggtctattgaaccattcaagcatcttcttcagagctttcatttgttttacctaaaacaatagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataactcttatcaatcattactgctacggtaattggaacgtctttagcaaacgacatactaatactattgatagacatttcaaacaaaatcgcttccataattttcctcaatcacaagatgtagatgaacaactagaatcacaagaactttcacatgaatcgcccgtccatacatgaacaggaacattagtatcatatgaatcagaactagactgtgtattctgtgcattagatgatgtagtaggtactgaccagcgccaaggatttttataatattcttgggcttcttcataagtcatagtaactgcttctactgttccatctcccatataaacatactcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattaattttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctctttcttctttttaggaatctgttcaggacctttatttactacagcgcctgacgttgttccagtagagatattttcaggattaccacctgaatctccagctaccatatcttctttaataaattctttatatgttttcatattaacctctattcataaaagcattaaaaatttggtcatcaatagatggcacagtaatattttctgcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacctcactattaaaacgtggttcatggaaactgtaataaaccttttcatctataaaatcgtatgaaattttttccatttttaaatatgaaaattcagaactatacatattaacctttattcataaaagcattaaaaatttgatcgtcaatagaaacatttactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaatattccaccgacatactctgtgctgcgtttaaagtttacacgtttcctaaatgaaaaatattcaggttctttatgagcccgactcataggacacaatgagtagctagaataagagatgtcaaatcctacaccttcaatatgagccaacgcgtcatgattaaaccaattataatcatatgccaaatccattatattgtaatatgtgaaaggcaccggattaacatcatgtgttgtacctttaaaatctgcccaggcaacgatttcgttatctttaacaattacaaaaattgtgtcaataagatatccacggttattttcatcaggcgttatattataacattgcgcatcaggaaatttaccgtatttaaacggtggatttttgtgcatataataaatcatattattcacctgtgatttcggttacgatatttttgttattaaagtttttatcgcaatacagaacataattatactgcattacaccaccagacttaagttgtttttgcactttagctttcatttcgggacgatcgcgctcaacaatattcataatatccgcttcaatttgagtttcaacttcagtctgatctgcagtcatagaccattcacacaagtctttatcatatcctgccatagcaggctgagcagcacaagaagccaaagtaaaaattgtagcaaaaataaattttttcatgataatctcctcagtagtttatgtttatatagtatctcaatttccaacaaaagtaaacagctattttaaaacttctgcataatcacatgttacaaactgtttctctagcttaacgattttacgaaaataccttttatactgacgaatctgcctcttcgtaggacgtacagcaaacttaataaattccactcgaccaaatggaggactttcttctgctggaatatctaacaccaattcccacgtatccgcaataagtgctttgaattgcgtatttttcctgacgttatacggagtaggtttaaataaaacaatatgcatattatcctcggtaatctacttcacatactttcttgtcatcaatgaaagctttaactagtgctttattaacttcagcatattgagtagtagcccattgaacgtcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgatcgaaatgtattagcatctgctccaccagtaggatactgtttaacgattaaacgaccgagagtagatttctcacgccatttttccatttttcctttatactcagcgtaagaaatatgcccatcatcaatgtcatcaagagaaacatcaagcatattagcatcaatacgtttagcgcagacttcttctgccatttccatggaaatgtaaagaacattatgtccgagctgtaaataatctgctgccaatgaacacagacctaatgacttaccaacgttaacgccagccattaaaacgttcagcgttccagtttcagctccgcctttagtaattttgtttagaattctgagtttaaatggaaccttacgagctttattcatataagatagccaacgtgcttcgtagtcatccatccaatcatgaccaacgtaactatcaaatgaaattgataatgcttggcgcatgatgtcaggaatagcaccaacatccggcattttcttatttcgtttttccggaggaagctcagcattagtttgaatttcaattattttagatgtggcgttaaacatcgccctttgctgaacatatttttctgtttcttttactaaccagctgtggtcttccggagaatcagccagttttgaaataagtgtttttacaccagaatattctgtttcagtaaatgaactattttctaatgcaacatttaacgcattaatagatggaacgctatgatactcgttgacatgagatttaattaatttgaatgtatttttagctggaccactttcaaaatattctgaatccatatatggccaaacttttgaaaaataagcttgatcaaatataagatgagaaagaataatttctaccacacttactccttaaaagaatttaaactttttctttgaccttttattaaatgcatcttgtagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcggatttaattatcttaagagattcattaaaaagacgttcttttctttcttcttccccctccgaagagggggattcatcgataatttctagatctaaatctaaatcatctttattcattaaattcttccatatcacttaactgctcgaggtcagtttctaaatcagcagctgatttacttttactttctggagatttaaatttttcaacctttgagttaatcaattcatcgacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcaccggtttcttcgtcaagaaattcacgagcataccagccatttttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttccgtttctttcttagaagccatattaccgattgagtcgatgaatacaataaccttttcaccacgctcaatagcttcaagctggttcaccatatcaattttcagttgttcaactgactgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaattgcaccagaaatagcaatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttgcgcgaaacacacatgcgaagaacctttaatggctcgtcttcttcacccaacgattttcgtttttcaatattagaagttttccaacgagcttgctctggaaactctctattgatttgctcaagagctctattatgttttgaattactacgaattgaactgcacccgcccggagcctgtgcttttccagatacaaccagatatttgaacaaggccaaatgcggataaccttgattaattaaattgagaaatgcatacatatcttcgcataaatcaatttttccatacccaatttgttctgttgtaagttttccaaggtcataccaagtattcgtgaatccatatgaattttcacgataattaccccaagatgaagtaattttaaaaataggtagacgagcatggccatgataataaccgcaatccatggcatctttaacgtattgaatcaattcatagaactgttcacgagttaattgattaattttatctacacagcgacgatcatctttctttcgcattgaactcatacgaatagtagtatcatcatcaatcatccaaattcgttgacctgcatacatatcagtaattgctttacgagtaccagcaattccgttaacatcatcaggaatagttataattttagctctagacccgtaagcgtcataataagctttttcttcgtgttcacgtactacaatatgcggttcataatcagatggaaacatatcaagggcagaaactgcccctacgcgttgatagcttggaattacgaattgaatcatttccactcaccgttataatcttttttcgcaatatgtgtttcaccagttttccaccaatggtcaaccaaataaaaatgacgggaatacacatgaaggctcccgacattccatataatggaacctgctttatactgacgagttgaatcacctgcattcaaatcagatactaatttatctaatacgtatttttgccatgcataatcattacggaatccgaagaccacgtcatttgaacgcatgcttactactgcattgactttcttatcacgaatcaggtactgtactgtattcgtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaaccccaacctaaaataatagttggaatcataagaggaaccgttacactatagtatatacttattataatcatcaagattaaaagcaacactgctataattttgcttttcattccttctctctgatgataattacctgatttggttgtgcagactttttagtttcacccgcaattgaccaaataaatgtaataaaccaaccaataattgaccagttaaacagtaaagacgtgaaaaagattcctactgttgattttgacccacgcatcaaggcgatgaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccagtacgccattggtaattattagcccaattagcccaaatttcggcgcagtagttttcaattttttcttcgcgtgtaattacatcagaattacgatatgcttgagcagattcatctggacgaatagcttcgtcaaaatttgcctgcatttgttctactgtttgctttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagatttaatcacaggttgagtatcattttcaacactaacaaatggaactgctactaatgcaactaaacaaactgctaagcatcccataacaattttcattttattctccaaatctgtatcagtagttgatagttgtatagtaccacagaggaacagtcttgtaaacagttttgtgaaaattttttagggaattctaaaggtccaaaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacgggcatttaaatcctggccaacctttatcatcatatttcgctatatcgttcgcagtttttacttcagcaataactttatagtcaagttgacgatattctttctcgaagttcttgtaatattcttggacagactcttcaccttcttgaagaatacgacgaatactttcttcgagagcttcttgtactgcttttggtgttgaactctgctgagtttccatacccatgatttttagatgtggttcagcaaatcgcttatcttccatatcataaacgttcagagcataacgttttttcgctttccaaaatccaccaacaccctttgaaccaagcggaggacaagaaatagcttcacggtccatatgcatcagatgctcgcgattattcatataatcacataactcacgatatgcaacatcaatcataggttccatctttttcttaccgaactgattcatgaattcaactaaatcattttgttctttaaagcggtcaagacctactttttcaataactttatctacacaaacatataccgaatcagtatcacctgctgcgatgaaatcttcaccattagttccacatactttattnagatattcattaattttacgagcaatccactgaataccaacttggccgaaaattgtgatagcagtagcatttcgcaaatcatagtaacgaaaatgaatattaccaagagcaccgtaaagactgttaataagaattttacggttcagctgatttgtgttagcaagtgtagctgctttttcacattcttcaatcaaactattgagaacagattcggtgtaattcgatagttcatttaagaaatcatcactgaacttaacatatcgttcaacttcaggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgcccacgaatagtctcaggactaatgttaacctgacgaataatgctcggatacagagacgtcaagtcaaaactcataatatatcgacgagcaattggtttaggttcaaacacaaatgcacccggaaaactctgtttaacgtgcgaaccctgttgaggaataaccttatgttcacctttcaatgagttaaaaataatggcatcccaggttttaataggactcattacaccagaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgctgagcaactgattccaaagagaatgacggcaaattagtaaatgcgaatttcttatacaaatctaaataatcaagaatagatacgccatcaatagaataaatttctttgctaccgtacatattttggataagtttagattttactcgaccgattggagagaagcgtttcatactacgttcaccgagaaccattttaacgcgattcatgatatacggaacgtcaaatccctcaatattccaaccagtaaaaatagcaggtcgtttctgttcccaaagattaatatattccatgagcatatcacgctcattatcaaatggcatataaattactcggtcaagaatttcttgaggaacttcatcaccaccttcacagtcaagcttagcagctaactttgcatcccattttgatactgaaccatacattgaattcaaaaggtcgaaaacataaaaacgatcgtcaattgaatcataatgagtgatagcatcaatttcatattctgctttcattgggtcaggaaatttatcaccagtaacctcaatgtcacagttagctacacgaacaaattttcggtcataaacaatttctgaaccatatgtatcactgatataagcgagtttaaaatcgttcataccgagagcttcgagaccgatgtcttccattctcttcatccaatctcgagcatctttcattgatggaaatttttgaggagcgcagtttttaccatagatgtctttgtactttgactcttccttacaatgcctaaacatagttggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaaataaggggccgaagccccttgcttaattaccaatcgtatatttaggaacgagtttccattcatgtttttgtttaaaagaaataactcggaagttattagttaaatctttcataaaagttctttgaccagggacgatttcaatcagtccccaatcttctaacagccatgcaatcgaatcacgacgaacttcatcttcttctgtcatttcaacttgacggccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataccgcttagcaagtaacttaataatcaatacttcggtggaatcttcaactagttttgcccatttaccatatcttttaccccgaggaactgcagccattagataattaaaatgagcttcatcacttaatccagaaccgattaaattcatagcatatacagctggcatgcactctggaaattttgataatgcattttcaaccatgaattttgaataatctttttgagcaatagagcatttagttttattattaatagctccaattatttcaaaaaactcattttcagctttttctttaaaagaatcagcagcggattggacagctgtccaatcttttgaataccaagcaacttgatgctcgtttaattgaatatcatcttcaaataagctcatatcacttccactgcatttcacatgctaactgaatgaaaagataagctaaatgcaattcagtattagctgcaataccatgatactgattattttcgccgacaatttcgtacatacgaataatactctgtggagttacacgtgaatagatttcttcggcaagtttaccaacaaaccaagaataatcggctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttgcagatttcagttaatcgacgaatcatctgcttcatcatttcaattttatcttcatcagttggttgaccgaatgtaataactcgacagcgtgactgaagcggtttaataataccatcaatattgttagcagtaataataatactacagtttgagctataagcttccataaaggaacgaagatgtcgctgagactctgctaaccctgagcggtcaaattcatcaataacgattactttttgacgaccatcaaatgaagcggcgctggcaaaattagtcaaaggaccacgaacgaaatcaattttacaatctgatccattcacaaacatcatatcagcatttacatcatgacacaatgcttttgctacagttgttttacctgttcctggagaaggagaatgaagaataatatgtggaatcttacctttacttgtaatagatttaaaggtttttttatcaaaggcgggaagaatacattcatcgatagtagatggacgatatttctgttcaagaatgtgttctttttcatttacggtaatcataatttcctcattcaagttttagtgtaaatttaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgtgcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcacgagtcataataaattgaccggatttaagcataataccggagttaatagtagcgaaatttttcagcagagcagtagtatctttagacagtttcatgtaatttccttcaattcaaatgagatttaattttataactaatttaataaagcaattaacgattaaaatcagccgcaattgtttcagcaacaatttgagcagcaacaattaggcgttcatctgcattaccgcaatattcatcttcaaggcgttcaccacatgaagtcataataaatttagcaccggcgtttagggattctgcagtatgtttgcgcattagttcaatccatttattacttacttcacgatcgatagcttcataatacgcatgacgagcaggtgcagatttaattttgttctgaataacttccattgcgttatcagaaagagacaaaacccatgcgcgacgaattttattttggttttgtggatttgattcagaacgcacgtgttttggctgaatatcttttacatcaacagtataattcacggtaattttagtcataatacacctttagtcataataatcagtaacagtccaagcttcatttctgttggacattattttcgtatattctgatttaaatgcattcttaagcatagattcagtaactatatgctcttcattagaaaaattatttctcagaatatatcgttttatttcaggaatagttaatagatgctgtccagttgaatattctgccacagttcctccgtataaatatgtttatcactcgctgtatcaaaaggatatgttatgaattataaactaatttatgaaaagttaatctctaatgctaaatctcgaaaacttgattgctatactgaatctcatcacattataccgcgctgtttaaatggaagtgatgatgcttcaaacttagtagatttaacaccagaagagcactatgtagctcatcaacttttagtaaaaatttatccttctgaaccaaaattagtctatgctgctaacatgatgacagtttctacgaaatacgctaaacgcaacaataaaactttcggttggattcgtcgtaaactctgggaaatagaaaagaacaaagaattctcccaggagacacgaaagaaaatgtctgatgcagtagctaataaagcaagactaacttgtcctcattgcggtaagtctggattaagcgggaatatgaatcgttggcattttgataactgcccaaatcaccctaatcctaaagttagaccaccaatgtctaaagaacacagaaataatatctcaaacgggcttaaagcaatcgttcttgaagaaacatcctgcgaattctgcggaatgataggcaagaaatgcgttatcgcagcgcatagaaatttctgcaagaaaaatccaaatggacgcaagaaaactgaaaagactggtacttgcgtccattgcggtaaagttaccactttcggaaatttatcaaggtggcataatgataactgtaaatataaacctagctaatcttagctaaactaaatctaccaactttttccatctgaatatgctgaccatattcttgtgggtcatggtctttatgcgaaattatgaagaagttggtatccttcaaaccatctaaaattttagctacatttttaatgccttcagcatcaaatgcaccatcatacacttcatcaagaaataaacaacttattttaacacctgaaactttttcagcaatatcacgccaagtaaataaaagagcaatatcaattcgtgctttttcaccttgactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcaatgctatttcatcagcatggtcaataaactcagaagatgctttttctatagctgctttaacttttttagctttatctactgtcgtgattagagattgctttttattgcgaatatcatttgccaacgactgctgggttttaatattatctcggtattcatcaacaagaacttttaaattatcacgatgtgttgaaagctgttcaaacgaatgcgtacattcagaaactttatctttaattttagaaacaactttatcaccggaacttaattgtgacaaacaggttggacataatccgccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgaagacgagtaaggttgtcacccgttaattttttctggcgttcaacgttatcattatatattttaatttgttggataatactatcttttttaacatcaagcacttggttctgcgaatttaattcacgtattagtgctttattaagcttatccatttcagctaatgttcctacctcaagcaggtcttccacaagctttcttcgtgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccattaatggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccgaatgtgatggcttctaacatagtagacttaccaccgccatttcgtccagtaataagagttttttgaaccttatctaattgaatgtcaataggatttccacctactgacattatattttgatatctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatatttgctatgaattcatcattaatgtcaaatgtcgaaaacttcacagtatgcatccttaatacaagatacagccatatctcgtaatgatttaggtgtgtcattatctaaaatgttgaagttaaaagatacagcccaatcagtgcagaccgtgacctttttaatacaattatcttcaacctctagcggttcaaaccaatattcaataatttctttatgcccaatatcatcttttacttcacattcaaaatgctgactcatcataacatttttaaattcatcaaaagtcattgtgttgcctctacatatagctgattcgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcaccggcagttagtgtccatggtgtcccaatatatctgacattagcagcctcagaaatagtatggaagtgaccagaccacacttctttataagtcttaaggaaatcaggttcaagaccgtgagatttcattcctttataaaaataaaatccattcagttcccagtgaccaacacaaaaagaagcagaagaagtttttatgtgctcgagaatttcaccagtattttcttcacacatccaaggaatcaaatcaatcaaacacccgtcaaaatctactgtagtaggcttatcatatactttaacattaggatatttagccaaaagctcagtagaggcatttggatgcattacatttttgtagtggagatcgtgatttcctacaatagtatgtagggtaataccagcatcatcaagcatttgaactatttcacgagcaaactccatagttttatgcgtgatcgcttttcgcacatcaaaaatatcaccgtattgaatccataccgtaattccatttttcttagaatattctatcgcttgcttaattccatcaatttgaataccgcgaatccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcgcggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccattcttaataaaccaatcacgttgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataggaatcaacccacactttcatattagggtctgctcttacaataggaggattaacttctttaattgaactatcatggtattctttttcagaaattttcacgcaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgttttagaatatcccgacttttcttgatagcatattcgtattgagcaaaattattgttttcagctgcagtctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacggctgtcatagacattgtgaacgaaataactatatttctttgcaacttccttacgttcttttttaatacgttggacgaatgcattaaaacaagcttgagttatatatgcatgtgggtttttatatttcgtttcatcaaaattatgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacaatatgcttggaatactttctccatcatctttttaaattcatgaatatctatataatgactagttaaatcagcatgatataaaaagtctaaaaacttttcatgtgtgctaacgtattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattgatcaacatattcaatcaattcgccgtaattggcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcgcccttccagccttcgtacatcattgcgactgacaatgacaaggctccttcgcatgctgcatacttattattccagaaccaatttagaaaaacttcgtcctcaataccattgtgtttcatgttctggaaaaatttggcgcgttcttcacgaagcttttgcgataacatagattcaggattcatttaaattttccaattaccgttttcatcaatgaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaagtattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggtaattcatatgttaataataccacagtttgagctcgttgtaaacaactttgtgaaaattattttagggaatgataagaagggaacgatagcttagaatggtaatatacagaatgtaagaaagaaaggcccagagggcccgccttagtcttctatgatatctctatcatatccaagtgaaatgagagtttctttgaagtgtttaatgttcttttgtctagaatcattgatgaaaatgactggataacgaatgttaagagatgtgaatccagcgcgtttagcaagagatacaatcagtggacgatcatactcaatcttaccattatttgtaagaactttatagaaagtaaaaggagcattaagctcctttagaagttttgtaactgattgacatccaggacaacgacctacttcatctggaattccatagacttcaatcttattctttaagttcgagttttgttccacgagaaataattccttgataagcccagtatggcgggttaacagaatcatcgccagaattttcttcaggaaaataaacctggataacaaatccagatgcatcaaaggtaaaataaaccgtaggtaattcacctaacaattcagcgcggttattaatttcttcaagttctcgttctcgtccagcccaaaaactaggatttagactacattcatagaaataatagtcattaccgaacatatcaaaacccttccaactctctaccacatatcgctcaaaactaatcataattaggcctttttatcaagaacagcattcagtttgttagtaattttatccagacgctcattgaactcgctagaagataagcctttttctggagaaattaagctaatcacgaaaaatatagcaataaaaggaataagaaaaatagcaccaactgccataaacaaaaagaacgttacagttgtaagaaaatcagctaaacctttacgaaatttatacatattttacccttaattctaagaccaggcattgataagcactaaactatattgcgaataaaattctggaccaaaatgaaaaatcatatcatttatagtatccataatgtaattcaatttacgccagaatgcgttcgcacagccgccagccggtcactccgttgatggttactcggaacagcagggagccgtcggggttgatcaggcgctcgtcgataattttgttgccgttccacagggtccctgttacagtgatctttttgccgtcgaacacggcgatgccttcatacggccgtccgaaatagtcgatcatgttcggcgtaaccccgtcgattaccagtgtgccatagtgcaggatcaccttaaagtgatgatcatccacagggtacaccaccttaaaaattttttcgatctggcccatttggtcgccgctcagaccttcatacgggatgatgacatggatgtcgatcttcagcccattttcaccgctcaggacaatcctttggatcggagttacggacaccccgagattctgaaacaaactggacacacctccctgttcaaggacttggtccaggttgtagccggctgtctgtcgccagtccccaacgaaatcttcgagtgtgaagaccattgtatatctcctctttaatcatgtttccacactccgtcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttcaccagtgaatggaacaccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaatagccacatgttcttcttattgtgttcatctttttaggatcagtttctccacaaatagaacaaacaaatccgttttcagtaggagtcatttcatgggtacttccacatgtaaaacatttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaatccggttctttcagtccactgcttaagatgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcactcaagaaactgcggcaacccattggagaaacaggaatagatgagccggtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattcgcaaaagtcgttccgccgtattggtgagaagcaacttgcgcagtaatttgtgccataattgcagtagcaactccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttagtgtcagattcattatattcaaatcctctttgaagcatctcagccatcatttcctcttttcctaaacgagaaaattcctttgatttatctccaacaaagttagggtgaatattattttgggtgtaatcggattttaaataagtaagtaaattttctaaccattcaagataatcaacaccttgcccctttaagccagaacgattaaatttatgtttcatttgaccttctgcggcattgcagagattacaaagcaatccacgtacctttcctgcttttggtccatttaattcatggtcatgatcaagatgattagcttgaacatcaggatttagttctcgttggcaaattaagcatttaccgttttgtgcatcataaaatttctgtttttcttctttgtataatttgccagtcaataacataataaacccttaccttaaatagataagggtatttattattttcaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgccccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataacctttgctgtcatcaaagttccatacccataataaactgcaacttcatcacctacatataccgcgcttccgcggtaatcatgaatatagtcatttccttcgagcatcatttaaaatattctcgcagttggtcaaatccaccaatatgacttccatcaggagcaaatacctggggcattgttaagccgatttgagtatcacgacctagtttagtcagaagctcagcgattttctcatcatcaaaaacacctttttccggcataatgttgataaattcaaacggctgtttcttcacagtcaaaagacgttttgcattatcacaatacacacatttgtggatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcagtcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatacatttccactacgtccataatttttaacatcatgcggagtttataagacaacgaacgaatagttttgttgtgcttattaatttctttagctgtaatggcgccaagattacgtgagtaataataaggaacctggatattaattaatactgatgaaccacctggcttgtgtgttacttcatcagcaataacccagtccttaacatgaactgtatttgtacggtcatcgcctgcagtaaacagcttgcgagcatgcttaaaaagcatattcacttggtcattgaattgacaagcaaatttatcagcaaatttagtttcaggaatggtagataaccaatcagccaaatgggtctttttaacatcgttaacaatagtaaattcaaccaaatcagttatagatgtcgcagatttaatgaagctcggcttcataaagtttttaatgttatcacgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaattatatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgatattttgaccaaacatcggtatagctttatcatcaataacgctattgaatgatttgatatattcgttacgagtcataataatctcctcagtagaaagtaagaacattataccacatccttgtggcaaagtaaactagttcagtgcatttagtgcattgttcagtttagaacgttgcttcgtgagatttttgactttttcttgtgctttttctagcatcttttcagcttctaacacttcattggtcgctttaacgagttcatcatctactgccttaagggacttctcaatcgcatccgcgtgccatttttcaacaggtttaagactcggattttcaataggaagaaaattcactttattgaatttccatgcatctttattacctgaactatacatccaaaatttaggatcatttgacgagtaattagataaatttaagttatcttgcacttcctgctttttctcttgcgggacttcgtcctttctcaaaaaatcgtatttaaatgaaacgatcatatcaagttcatatgatgttgtatctaacttaaatcgttcaaaacgaggtaaaatcttagattgaacagcagcaacaacatccatatacttaaatgcttctgtcaactgtgatttaagacattcacaaattgaaagagaatttttagtattaggcttaaagctgattcgcgcagttcgattattttctttagatggtcttacttccatttgaagagtataaccatcaaatttcagattctttaagttaatatcagaaccttttaatcgactagccgtagacaaaatttgctttaattgtttacggaataaagcaataaatctccattcaagacgataatgatttggattataaaatcccgttgatagatcaactttactttgaccaacgccttgaacaagtagaggatttttataatcaacggttttacagaaatccatgagctgttcacgggcagtcatttgcgtaatatatccagctttatcaaaatgccgcaaccattcagcgctattcaatgagttaaagtgaatattacgtgtaactttatcagggtctaaattattttcacataaaaatgttatgacattacgagtataactagcattacgaaccatatcttcaatttgagaacgagttttcatagtattccttaaaatttaagtaaatcgataattttaattaaattttcacgctcagatttagctttactgcttaatccagacaatctaaaaatttcatcgtcatattgttgaatagaaatatttagctcttcaatttgcttattaaaataatcaatttgttcagaatgtttttcgttactacgaactggtacaggttttgtaggaaatttagttaaactggattcatccgggcgataaattaaaatgcaatttgaaccaatcgggcatttagcaccagatgaatattctaacgttccagcttcttttaaaacttcaaaagctaaacagagatgatgccccatattaacataatctgtagagcgagctctgatataataatcatcgccgcgaatactaaatttaaagcatttaaggtcttctgtattattggtcttaaaaatcatttgtttatctagacctttagctaatcgagcgcctaatgctaataatcgtcgttgattttcccacaaatctgcgatcatttggtcaaatgataatttcggcattaatcgaccataaaggtcatatcctttattataattgcgaaggatttcactcgcattaatacgagacaacgctccaattttattaagggctttcatgatgcgattagataaacccattccagacccgtttgttcgttgtaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcattcaattttttattaactaaagatttaattactgcattgacattattaattactactgacatatttcctcactcaatttcaattttactaaatacgcagaatatgatggaaaagactatataagcaccgcatacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttataagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgataaactcaatatcttcttgagttacacgagataatttagatgctttatcctttttgtactgttcgttagtatcacgagaccagtgtaatgtacgatttttattcgtatttttgtaaatttctacaataccgatctcatcgataataacgatccaattccaacgggatttgtaaatttgtcctccatcaacagtgatttcacctccgattgagatgtcattaaagaacttgctttgcgcttcagatttaaatttaccatcgttgtaatttactaagttgaaaatatctttagcgttcattttctgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatattcccaatcatttgtccatcgcatcgttgttgcgaattgaagtacagcttctttaattttagtttcgtaaatttcacgagcctttgagtataacatcattacctccatttaccagtttaattctagtcatctttttgatggcagtccatataatctatttctgaactgcctttttgtcatagaagtcctcttatgaattatttcagaagagtaacctcagcgatttcttcccaaccgtttttgtcggtcataataaagtcagcaagataaagagcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaactgagcgggacactaatgcttgtaaatgtggagcaagtttagtaccacggtctaattcgcggtcaatatcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaaagggagcccgaaggctccctatcatttataataacttcggtggttttcaagatagaccttctcaaggaagtcatcccagaaactcatgtctactttttgctgcataccgttcttagaagcttcagtagatgatgcttctacttgatcgaccacatcttccaaaaactcttgaactgttttaaatggatgcttacccaacttcacgtcgagaataaatggagcatcttggagtggataaatcaagtcgccagttttgtaaatttccaatagttggagtccaccacgacaagcatgactcaaagctttccagtcaataccttcattggcttcggccttacgagcacgttcaccatattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtgcgacgctgcttaatagaaccatcttcttggtaatcaatccactgctcagggatttgattaactactttcaatacatcacgtaatgcagccaaacgagaacctttgacaccgtatttagaagcttgcttgcggacatatcctaaatatgatttcatgttagtcgtataaaaacgagaacggttgtcttgaataaacttccacacatcaggcaaatcagatttaaccactagttcaggtggagtgtgaagcatatccaatgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgatgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaataagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatgaataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataaccttgccaacttgtaaaccattaaatgacgttttcaataaaattctgaagctttgtgtgagcatcaaccatgattttcatttcttcctttgcgaaagctgtacctctttccctagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccatcgtatgagtatccttcacaatgctcaactgctaattgatatgaatctatttcaacatcacgtgctaatttaataatttttcaaactgttcacgtgttagcatacttaaactctcgtattatgatcgataatttcatcaagaaacatatctaaagcttctacagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgtgatcaatcattctaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcacgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcgtattcacataagctattaattcgttttctttcttatcaaaccgatcagcaaattcttcttgctgatcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatattgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcaattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaagtattccactttttagcatatcgttttaacaatgtatcatttttatatctgcttgatttatctctttctccgtctttatatgcatatattaatttctgcgcaaattcagcttggcatgctttatttttcccacaataatccgcggcagtacggtttacataatctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagaggatatcgcctttcttatatcgcccttatgtatatttaaccaataagaaagttcaatgtacgcccaggaagctgaattggaccgtttattcaacattctttttatttcagcatcggtcatattataaccaagttccttaactcttgctcgcatagtaggcaaataattttggaacattccataggcatgatgctttggtttagattttaaattaactccggcagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaactttgcgttaggtttacaaactgtaaatccaagccaaagatttccatctgtgatttctaaacgtccaggacgatattcaaccccctcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacgctgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccaatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcgctcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacaggtactaataaaagcggaactaccaatggaagaattagtgttgctccaaatattgcaccagattcaatatcagtcataacgtctataaccattccagcaatcaccagaatcacaaatgatacaactaccacaggacctattaacacatcagtagaaattagctgacgctttggttcatacttcacaggtttacttggaaggtatagtgatggctttgacatattctttacattccttaacaaatttttctaataataaatcgctttcaaaattgggattttctacgaatttatcaaaaagatcatcaacaatagttaagatattctttttactaagaatacgcttattttcatattttgtttcagagtcaactataaaagtaaagaaatatttctttccctgaaattttaccgtagtatcaatataaaataaatttgatttttgtaaattacgtttaaaccatgcatcacttaaactataaacgccaagataatcataatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatacgtttaagagcatttagtaattgatctggaacatcaacctgtctttggaactcttcaaacattgaattgaaatcactttgcattttcattcctatttactccaagtaataggggccgaagccccttatcattatttcagagaattaatatattcctggacatcggcagaggtagtttcaaccccagaaatattgccgttaaaagtttcaactcgagcaagggtatcttcaatatcaaccttagtcagtgctgcaatttcaactacatcatcggcagtactaattccaagggcatttgccgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcatcaagttacaggctcataatatctcaatcatgagcctatgtaaacttatttcatattattaaaatattcttctgcgatttcgtcgttatcgtggtaaactttagaagacagtttaacataaccttcagcagtgaacatattaatcacaacctttacagtataccactgtccgtcttcattacccattactgcgtaagtttcaaacatcggatggtcaggaccgataactttaatatcattcactgtacgaccaaaatcttctgaaacgcatttcataaagaagttgaacagttcgccgtaattatccatttcattctccaagttgtttttctgtatcagtagttgatagttgtatagtaccatggaagaacagggatgtaaaccattttgtgaaaaaaatttttaaaagttttagggaattctagggagggatgggcaattaaaggataggataatatattataaagggtataaactaaatgatgcctagagaggtccagaaaggcctagataccaaaaagccctatcatttagatagggatttaaaattatttatctagtttagttattatagcttctgcagcagcttttagcttagatgcggtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccatttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtagcagcattctctatgtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttaccagaagcctttgcaaaagcagcgccagtagcaactagacttttccaggccatactaactgcatttcccgtaaatccttctgctttcatgtcgcgagcaaattggaatcgtgattcgtcagaagcatctttataggaatatttacccgctgcaatggctgcttttgcgacagcttgaatttcggtgctagatgcttcatttaacaccgcttcatttaaaaattgagcatatgatttcatcttatttcctgttttaattcgtggatttaatatactactgtatttatactaaaaagccccaacctttcggtcggggctaagccttgcggcaaccttgtcggggttccacctgctaaggcaagtgtttgtacgaaacgccgggatttgaacccggttattaagcagttgacgctactcaatatttttaaaaggccatatctcgaccatatccgaacgttccgtcaaaaacgctactcggcttacggcaaagatatttcctcgaatcgataattcggtgcgccgtttcagctgtgatagtaaagaaccagaacatagtaaaactgtgggaggaactatactccagggaacatcagtccgacgacttaccggtagcgacccggtttcttaatattcttttaaagcatcaatatgttcacggcatttacgccataaatcaattgcttcatacgcagattcagcatttcgaattggacggcatttatataaagacttgtgattttgatattgcgtagataacggaattttatctaaaaggtctttatgttcaaagtattcataaccatctaagccaaatgaacgatttttaagaaattgccaatgaccgtattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggctgacgtgataggattcgaacctataaccaatcgcttaacaggcgatcgctctgccattgagctacacatccaaattggtggggagtgatggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccatacaaggatttgaaccttggacctcctgatcccaaatcaggcgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctcaagcaagaacccttgatgatagagggtattaatcagtgcggtatgagttaataataacaaataattcttaaagcaaattaaacattttaacggtcggcaaaacaatttcttcttctatataagagtatttaacactctcaactacacgcaagaaatcatagtcataatattcagaagcatgaccaagaatatcaataaggccttcaaatatcttattaccattcacaaagaataagtcaaatacacgttcttcatcttcttcggatttattaccaaggtcaacttctatatcaaagacctttttaatgaattctggataaagttgttctgagaacagtccttcaaccaagtattcataaataaaaagcgattgctcgctgaacaagccattaccacaataacgttcagctttagtactagaatgtctgcttttaaacttctttaaaagatattggaactgtaagatttcatgctcttctacgccaaacagtgttttagttttatagttgtcaccatcattttcccaggtagtgacatcaattacgtagccctgcggaattgtagtacctaaacaaatattcatttttcaccatgctgcgttaatgtaagtatatttaatacattcaagacccaaaggattcttgaaaatatcatattcaagaagacctttttctgtttcaataaagaaatcaaaatttactgtattaaatttacggtcttccttcactaatttaacttgtgaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttatagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcagtaattttgttaaatgctacgaaattaactgattcttttccttcgtcatcaaaaacaaacacacctttaattgggcttttaccattaagatagcaaaatgcttgttccataatcgtgattacttctaatttagtcagatttaaattagtctcacgatcatagtcaattccttcaaactctttacgagttaagcaaggatagtcggtgtttgctgcaaatactccccatgcataagccaatgcatccttaataggaccagcaagttggtatttaactgcagaataattactcatgataaaatcagcagtagtatcttttccactacgctttacaccgcttaaaaagattagtttcatgtgtttctcctcaaatttaattaagattataacacacaaagctgaagcattaaacttctgctataattttaccatctttttctacttgaaaataggtgtaaggaatcgttgctgtacatactaaagccgggtctgaatcttccgtgtagctaaattctacttcagataggtcagaaacccaaggcttataaaaatttattgacatcacgatttcagttttactattatctaaaatgtaaagcgtaatgtattcaggacctgttttttgggcagtattttcgcctgtaagatagttactagttcctagcatccattcatacattcctatccacgacttaagctcttcgtcaactataaatctcacgatgagtggatcgtactcaaatgtaacacctggacgttgtgctcgaccaagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataaatgttggtggtataatgggtctaagtcccttccattcaattccaattagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccggggatatatgccttaatcatttggtctgcacccctaaatcctttcacttgactccaatcaatttttaatttagttttattagtaatagtaggtgtatttgaatattgctttaaaagctcttctagaaattgctgacgagctttaggtggaatatagtgcaagtttaatccgtacattaaattatgtttacctaaaccaaggtaaattattaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcacgcaatgtttgtctgaatgaatttatcataagcagttgtctttcttgcttattgagtttattcattggttttgattcaagcttttgaatcttttcagccgttttaattcctgaagcatattttgacattgccgaagtaaacgtagagtatttgattcctctttcttcagcaaattgctttcctgtcattccttttgctttggcctttctgtattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagattgtgctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccgcagttgtattgggttttattgatgtgtaatgataattatgatccgtattatggatggattacttcgcaagaagctgcttatcaagcatctatacaaaaatacaaaaacgtaggtggagaccaaatagtatatcatgtgaatgagaacggtgaaaaattttataatttaatatcatacgatgataatccatatgtttggtatgacaaaggcgataaagctagaaaatatcctcaatatgaaggagcacttgctgcggtcgatacgtatgaagctgctgttcttgaaaatgaaaaacttcgtcaaataaaaataatagcaaaatcagacatcaattcatttatgaacgaccttatacgtataatggagaaatcttatggaaatgataagtaataaccttaattggtttgttggtgttgttgaagatagaatggacccattaaaattaggtcgtgttcgtgttcgtgtagttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaatggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataagtgtgttactgccggccatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagcggttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgcgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaataccgagttttattttggtgaaggtgagatttctgttaatgcggcagaaggagcattgaccgctaattatattggaggtcttaaacctactcagaactctacgattgttattgaatacatcagtactaacggtgcagatgcgaacggcgcagtcggattttcatatgcagatacattaacaaatataactgtcatcaacattaatgaaaatccaaacgatgacccagattttgttggggcagatggcggcggcgatccagaagatattgaacgtattcgcgaattgggtactattaaacgcgaaacccagcaacgctgcgtaactgcgactgactatgatacattcgtttcagagagatttggttctattattcaagcagttcagacgttcactgattctactaaacctggttatgcatttattgctgctaaacctaaatcaggactatatttaactactgtacagcgcgaagatattaaaaattatctcaaagactataatttagctcctattacgccatcaattatttctcctaattacctttttattaagactaatttaaaagtcacatatgctttaaataagctgcaagaatccgaacagtggctcgaaggtcaaataattgataaaattgatcgttattataccgaagatgtagaaatttttaactcatctttcgctaaatctaagatgttgacatatgtagatgatgcagatcattctatcattggctcatccgcgacaattcaaattgttcgtgaagtacaaaacttctataaaacgcctgaagcaggtattaaatacaataatcaaataaaagaccgttctatggaatctaatacgttttcatttaattctggacgaaaggttgtaaatcctgatactggtttagaagaagatgtattatatgacgttcgcatagtatcaacagaccgaaattctaaaggaattggtaaagttattattggtccatttgcttctggcgatgttacagaaaataaaaacattcgtccatatacaggaaacgattttaacaaattagcaaattctgatggacgcgacaaatactatgttatcggtgaaataaattatccagctgatgtgatttattggaatatcgctaaaattaatttaacatctgaaaaatttgaagttcagaccattgaattatattctgacccaaccgatgatgttatctttactcgcgatggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaagacagactcgggggaaaatctcccgagtaatcaatatagatggattaacttaggatatactgcaaataacagcttcttttttgacgatgctgacccattgacatcatacattattagagtagctacagctgcacaagattttgagcagtctgattggatttataccgaagagtttgaaacttttgctacaaatgcttatacatttcaaaacatgattgaaatgcaattagctaataaattcattcaggaaaaatttactcttaataattctgactatgttaattttaataatgacactataatggctgcattgatgaatgaatcattccaattcagcccatcatatgctgatgtttcatcaataagtaattttattattggtgaaaatgagtatcatgaaatacaaggttctattcagcaagtatgtaaggatattaatcgagtttatttgatggaatcagaagggattctatatctttttgagcgttatcaacctgtagttaaagtatccaatgataaaggtcaaacctggaaagctgtaaagctcttcaatgaccgtgtaggatatcctttatctaagactgtatattaccaatctgcgagcacaacatatgttctaggatacgacaagattttctatggccgcaaatctactgatgttagatggtcagctgatgatgtcagatttagttcgcaggacataacattcgctaaacttggtgatcaacttcatttgggatttgatgttgaaatctttggtacttatgctacattacctgcaaacgtgtatcgtatagctgaagctattacttgcaccgatgattacatttacgttgtcgccagagacaaagttagatacataaaaacgagtaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacac

SEQ ID NO: 5 - DNA, 35 bp, Artificial Sequence
  Description of Artificial Sequence: Synthetic oligonucleotide
caagagtataaagaggagatatacaatggtcttca

SEQ ID NO: 6 - DNA, 32 bp, Artificial Sequence
  Description of Artificial Sequence: Synthetic oligonucleotide
aacgcattctggcgtaatgtgaataaataccc

SEQ ID NO: 7 - DNA, 34 bp, Artificial Sequence
  Description of Artificial Sequence: Synthetic oligonucleotide
aagaccattgtatatctcctctttaatcatgttt

SEQ ID NO: 8 - DNA, 29 bp, Artificial Sequence
  Description of Artificial Sequence: Synthetic oligonucleotide
ataatgtaattcaatttacgccagaatgc

SEQ ID NO: 9 - DNA, 20 bp, Escherichia phage K2
ccatagtcataaccaccacc

SEQ ID NO: 10 - DNA, 20 bp, Escherichia phage K2
acaccaaacagaatatcaga

SEQ ID NO: 11 - RNA, 103 nt, Artificial Sequence
  Description of Artificial Sequence: Synthetic polynucleotide
ccauagucauaaccaccaccguuuuagagcuagaaauagcaaguuaaaauaaggcuaguccguuaucaacuugaaaaaguggcaccgagucggugcuuuuuuu

SEQ ID NO: 12 - RNA, 103 nt, Artificial Sequence
  Description of Artificial Sequence: Synthetic polynucleotide
acaccaaacagaauaucagaguuuuagagcuagaaauagcaaguuaaaauaaggcuaguccguuaucaacuugaaaaaguggcaccgagucggugcuuuuuuu

SEQ ID NO: 13 - DNA, 20 bp, Escherichia phage K2
atgcttggttaatcaattaa

SEQ ID NO: 14 - DNA, 20 bp, Escherichia phage K2
gactttggtcaaataccgat

SEQ ID NO: 15 - RNA, 103 nt, Artificial Sequence
  Description of Artificial Sequence: Synthetic polynucleotide
augcuugguuaaucaauuaaguuuuagagcuagaaauagcaaguuaaaauaaggcuaguccguuaucaacuugaaaaaguggcaccgagucggugcuuuuuuu

SEQ ID NO: 16 - RNA, 103 nt, Artificial Sequence
  Description of Artificial Sequence: Synthetic polynucleotide
gacuuuggucaaauaccgauguuuuagagcuagaaauagcaaguuaaaauaaggcuaguccguuaucaacuugaaaaaguggcaccgagucggugcuuuuuuu

SEQ ID NO: 17 - DNA, 23 bp, Escherichia phage K2
ccatagtcataaccaccacccgg

SEQ ID NO: 18 - DNA, 23 bp, Escherichia phage K2
acaccaaacagaatatcagaggg

SEQ ID NO: 19 - DNA, 23 bp, Escherichia phage K2
atgcttggttaatcaattaaggg

SEQ ID NO: 20 - DNA, 23 bp, Escherichia phage K2
gactttggtcaaataccgatggg

SEQ ID NO: 21 - DNA, 269 bp, Artificial Sequence
  Description of Artificial Sequence: Synthetic polynucleotide
cagacctaaggtctcttagcccatagtcataaccaccaccgttttagagctagaaatagcaagttaaaataaggctagtccgttatcaacttgaaaaagtggcaccgagtcggtgctttttttgctaactgataccgactacgcctgaacagtcgaatcttcacctcgtctggtaccgacgcggtcccttgacagctagctcagtcctaggtataatgctagcacaccaaacagaatatcagagttttcgagaccagctcgtaggctaa

SEQ ID NO: 22 - DNA, 269 bp, Artificial Sequence
  Description of Artificial Sequence: Synthetic polynucleotide
cagacctaaggtctcttagcatgcttggttaatcaattaagttttagagctagaaatagcaagttaaaataaggctagtccgttatcaacttgaaaaagtggcaccgagtcggtgctttttttgctaactgataccgactacgcctgaacagtcgaatcttcacctcgtctggtaccgacgcggtcccttgacagctagctcagtcctaggtataatgctagcgactttggtcaaataccgatgttttcgagaccagctcgtaggctaa

SEQ ID NO: 23 - DNA, 117957 bp, Artificial Sequence
  Description of Artificial Sequence: Synthetic polynucleotide
  modified_base (4494)..(4494): a, c, t, g, unknown or other
  modified_base (4497)..(4497): a, c, t, g, unknown or other
  modified_base (12685)..(12685): a, c, t, g, unknown or other
  modified_base (61659)..(61659): a, c, t, g, unknown or other
atgtgtttccagaaaatttcttctttaactacatcatctttacgagtatcgccttgtttgcgttggatatgcaaattaaacggaatatcgttttgtaaaagccactcacgtgtcataacataatattttaacttagcattttcggtgccagattcacgtccgcttacagtaataatctcataacccgagtgatgaagcatcttcagatattgtacaaccatttcgtttggtgtatcggttgataatttatctaattcgtatgggccacgagatgtatgaatagctagtgttccatcaaggtcaaagattgcagcttttggtttaccaggagtccctttgtataccggaagaccgagatactctcgcatacttttatacattgagcgtaaaacatcaattggtactgctttagttccacgttttgagttacgtttaaccaattcagtccaaggaacatcaaacactttatattcaactttccatccgtattctttggcaaaagtttcccatgctaggcgacgttcaggattcaagttagtgtctgaaataattactcccttgacagaatcaccgccgtacagaatactcttcgcggtatcaaactgcataccggtcacaatgccttctttctttttggtatacttgtactcgtcacgttcttcatgacccatgatggattgacgataatcatcacgattgatattataaaatccaggatttttagcaataaattcacgagcccaagtgctcttacctgaaccaggacagccaatagttaaaataatctttttcatcatttaattcctaagaaaacttcaagaatacgaatattatgctcacgtcgctctttatacacttcagctgttgattgattcactgatttgctctgaacattagatgaaataaattttatcatgtgatttttaagctgatacatatcaagtccacgagcttttgcttcttttcgtagagctttaccagcgtcatctaaagctttcgtagggtcttcatcatttaatactattccacgatccaaatccatgtatactgcaccatgacatgcatcaatgtaaaggtctgagcattcaatataacgttctaacagagttttcatttatttttctcaactaatgattgaatataatcatgcaggtctttagatgctttaccccacttattttgatattcatttttgagattagcacgggattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatgacataccgacccaagctttaccatcaataactttaacttgccaagatagtttagcttcatcatatgactttatctgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaataaacacttcacaatcatacttagcgagttgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgtaaatccatcataaagtcctcatgttatgtcagtaagtctactataacacaacacgaggggtttgtaaacagcttagtatccttctgggataaattttttataatttttcaaaaaattctgttcgatttcacacatgaccttttcttgactatcgtacccctggtataagctcatgatgataccgaacagatgttccattccagcacctttagcaacgccttgcgcttccattgcataagtctttctatccttaccacaatgtttattgtgacagtcaagaactaaaaacagagctcggtctaagtacttcagataagtcgtttcaaacgcctcaatttttctgtatgaatattcatcatcagcgtacattgctttaagatcatctgatgcaccatcaataatagtcttaaacagtttttctggattgtctaatgagctttttgtactatgaagagacacgtaccagtcagacttaattttaaaatgagaaccatctttcatcacagcaacatagccttcgatgttttccgcatttttagcttcttctacccatttagggctatcgatttcgtatcgttcaactagatatggacgaagaacagcatctttataaatgtcatcatatgaaatgtattcacctgtttcattttcacgaatattcaataaaatgattttcacctcttgataagcaagaacgattctattagttggagcgacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcatctggaagtaaccaatcagaataagatgcataattatatgagaaaattctgtaagttcttccagatgcacttacatcatctgagtaaaaaaacttacgctgtgaatccttacatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgcggcgcggattgaacattatcagaattaaggtattcacgaatccaaggatatggatgtttaaccggagcaccggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgntcncactctttggcaattttaacccattcatcaccatcagtgccaagttgaagttgacgaataatatattgtgtacctttaaggtggagttgctcatcacgcgcaataaatttcataatcttcgcgttaccttccatgatttccatattcttatggaagttgaaagtacatgcaaaagatacataaaaacggatagcttccagggcattgataacgtgcaagcagagataaagcgacttcatcaggtcacgtttacaacctgcaacatggtcaatagcgtcttggacaagttcttcatcatgctctgttgccaggtagaattctacgtcagctttagcgttttcccattcacgagtctttaccagaacatcatcataataacgaccaatcgattcagcacgtttcatgattgcatcatcaagaataatctcatcaaataccttggcagggtcattgaacaggttacgcatgatgtgagtataagaacgtgagtgaatagtttcactgaatgtccaagttgcagtccatgtatctaatgacgggtcagaaatcaatggcatcagtactgctgcaggagcacgtccttgaatactatctaacaatgactgatatttcaggttgttagtaaaaatattttgctgatactgaggaagcttattaaactgtgcagcatccatcatcaagtttacttcttcaggacgccagaaaaatgataattgcttttcggttaaatcttcaaaaactttatgacgttgaatatcataacgtgcaataccaagacctgaaccaaaaaacataggttcttttaaaacatcaactggatttgtattaaaaactgtgctcataaattttccacttagttaatagttggtgactcgtccatgagtcaaattatatcataatttacaggatgaacaatcttcagcttttggagtttctatttcataatcatcagtaccagaaccgtcacgggtattatgataatagaaattttttccgccaaaataccagaaatacaaaaggtcatcaatcattattgacattggaaccttgcctttagggaagatttgggggtcatagtatgtattcgctgaagctgattgacatacccatttcagcataatagctacctgcgtaagataaggtttattacctttcttagctaatttccatgtataatcatataagtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcacaaggtcctttttctttggcgagcttaatggatgctttaatgagtccatactgtaatctctcaaatagttcatgtgttaaatcgttagcatcttcataagaagcaaagttacttgccaaccaagctgcatagttagtaacacctacgccgaggttacgacgctttttagctttttctgcttcaggaactggatatccttggtaatccaaaagattatcaagagcacgaacctggacttctgccaattcattaattttatcttggtcttgccagtcaaaattatccagtacgaatgcagagagagtacacaatccaatttcagcatcaggactattcacatcatttgttggaatagcaatttcacagcacaagttactctgacgaatagatgccttttcacgaataaacggagtatagttattcgtattatcaatgaactgcacataaatccttgctgttcctgaacgttcagtcatgagcaattcaaatagttcacgggctttaatacgctttttacgaatattagggtctttttctgctgcttcgtataattcacggaaacggtcttggtctttaaaataagaataatacagctctccacccatttcatgcggactgaacaaagtaatgtaatcgttctttccgaatcgttccatcatcaaatcattcagctgaacaccataatccatatgacgaatgcggttttcttctacgcctttgttatttttcaaaacgagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcggaagccttattgatagacttcaatgaatctcctgcctcaataacaacgcatgaactgaactgtcgagtcggagtacggcaaccagccataataggagttggcagtgaaatctgtcgagtagatactgcttcataaaaacgaataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgttcgtgcttaatttttgattctaaaaatgtaatttcttctgctgaatattttgacaataattcggggtcatatttaccttcatttacacagtaagaaatatggtcaataaatgaacgtggttcatattgcccgtaaacatgcttacgaagagcaaacattaaacagcgtgcagctacgtattgataatcaggctcttcaactgaaatagaattcgcagcagccttaatgacaatagtctgaatgtcatcagtggtcattccatcacggagatatgatttaatattttcatataattcataaggatctacagatgttccttcagctgcccaagataaaactttaataattttttgtggatcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaacgacaccagaagtatctttaaatcgtaaaatcatatatcctcgcaattaaattaaaattataccgccatttttcctttcaagacaccgtgggactgataatctttgagaacgaaatctttaggcctgagtttaagaatatattccaattgttctttagtagaaagataacggaatttataaggcaatccgcctattaccagttcacaaagctctttaggttcacgacgtaaaatttctttacattgttctacgtgattcatatagatatgagtattaccgccagaaaatatcaaatctccaggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcgtcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatatatttaagttcagctggattccatgctgaaacaatttgacgcctatcatttggcagttttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccatattagctcagcaatgcaagctttccaggcgagcttcttagttgttactgcaggaaaacctttagttaaatcccagcgtaatttagtaccgaacaaagcaattgttcctgtgcctgttcggtcatcggttttgtagccattttccaggatatctttaattaaaaattggtattgtttcattagttcatccaagaatatgtagaaggatatttggcaaagttaggcttatatcctaatttaaccatttgttttgctttgcgagtaaatcctaaagaacgctcacctttaagatattgttttggtgtcataggcccttgatgcatctgcctacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcgtctaattgaaccgttgaattaacacgatgccttttaacgatgcgagaaacaactacttcatctgcataaggtaacgcagcatataacagagcaggcccgccaattacacttactttagaattctggtcaagcatagtctcgaatggtacattagggcttgacacttgaatttcgccgccagaaatgtaagttatatattgctcccaagtaatatagaaatgtgctaaatcgccgtctttagttacaggataatcacgctcaaggtcacacaccacaatatggctacgaccgggaagtaatgtagataatgactggaacgttttagcacccataatcataattgtaccttcggtacgagctttaaaattctggaggtcctttttaattcgtccccatggtaaaccatcacctaaaccgaatgctaattcattaaagccttcgaccgttttagttggagaataagcgaataccaatttaatcattacgcaaaacccctttcaataaaccattcagtggctttattagcatcaaagaataattcttcatacgtcttttctttgttttcaaaaactgtcacacaaacacgttgacattctccacagtattcttctgacatgctcaaagcgtcagaaaacatttcgttaaattcacttaaatcaggattatgcaatgcgttaaaaattgcataatcgaattcatcattcataaattcaaatacaaaaatcatattacctcccactgaaaggggccagaagcaaatccgctatctttaatcattttaactaaagttaccattcctttgttaactgcttgtgcgatttcatcaaaaacttcatcgctatcatcataaaggtcattaaaaagttctaacacgttcttctgaacttttaatttatgaccaacaatctcgcctacagtaaattcgtttccgccgattccagtgtaaaacgtaattacaccagttaacagactttcgcgagaatctaggtcatgtgataaattaatataagccatcccgggtgcagttttaagttggcaacgaattcttacttgggtaattccggttacatgaatgacggacatattattttcctcaaatagactttttcacaattttccaatcagctttaaactgatcaacgtcagaatgataaatccagaatcctgcgctttctccatcctcataaagagggcatctatcacattcatcttcccatcccatatcacgcaaaagatgttcagctttttcaacaagcccagaatctttaccgatgatattaaaataccatttacctttaacttctgaatctttgatgctctggcgttgtaatctcattttattctccttagcaagctttaatcaaaagatataaacagaccaacataactgctgccataatataaggtgcgaacattttcttttctccattagttttgatagggtaatagtattatcacactactaccctgttgtaaactactttttgaaagtttttcgcaaaagttcaatgatttcatctacattattttcgtcaacaatgcagtgaatttttgttacgccagaaaccttgtctttaacttcatcctcttcagaagtaggttctttatattcgtggaaacaatgaaattcgtcttcacaaacgttaaagtaaaaatgctttccatttgcgcattcaatgtgttttattactctaaatccatcaacaaagaaagcttctttaacttcaaaccatccaccattttcttgaataattttaactattgatgaattagaacgtgggcgataattaataaatgtatcaataagtcttggaacaagctcatactttttgccaatatacattacgttttcctcattttaacggggcttgtaatagccccttgataattattgttcaatcaatcccatgtaaaattctgcgtcttcagaatccataccatcacaatattcattagccataaagcgggtgaggtcttcaagaggaccttcaatgacaatagaaaaattgcaataattgggatcatcgtgaatacttgtgatactaagttcaggataacgattacgaataatttcttcaatatattcaaaatcaacgatgtcaatatcaactttagccatattattttcctctttaattatcagcagtattgccgatagttgtatagtaccatggaaggacaaggatgtaaaccgttttatgaaaaatttttgaaataaaaaaggggacctctagggtccccaattaattagtaatataatctattaaaggtcattcaaaaggtcatccaggtcngtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttactacaagaatgttagcccagtaagaagttttacgtttaacaagactgtactctttattgtcagtgttgtacagatcatttttactgatatactgacatactggacaagaatcgtaatcaccgtaggtagatgagcatgtttcgatataccatttaccatttttcttgaaaccgtgatttacaagaagtgcgaatggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgcagaagtttaaaaatataacttgactgaacctttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcttggttagcaaccagattgcttataaagattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatatatctttcaccaacagcaggcatgcggagtttaatcatagtagaaaatctaatgtattagttttttcacaacgaacaacagaaggacgtaaaagattttcgtcaatagcttctgactgaattttttcaattatacccgaaggaataaatttagcaaattgagtttcaggaatagaattttcttctaagaatgctgttgtagcttcgagataactcattccaaactcttctaccattttttcaataataaatccattttcttggcggtcaagaagctttgcaatttcatccttttctttcttaattgaaagttctttttctgaaagaccggtctcatcgaccggacgaatatcatttagagaaaactgtgtcataaagttcaactacctcttcagtttcagcttcaaacacatcacggttatctttatgatacaaagctaacagacgattaaacatcttgccatcaacaccaagttcatctttggcacgaattcgaatatctttaatcaattcattataaccagaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccgcgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacaatagaggttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttgtgcatcggtgaccattgcttaacatttgggtatttgtgaagttgagtaaagtcaccatccgacgaaatgattaaaatcttatgtccttctaaagagaactttttaacaagaacagcgatatgatcatctgcttcatacttatcaatatccataacgatgtatggcatataagctttcaattcatctataactttatggctggattcaaaataaccttcccagtcccaagtagattcttctcgtgcttttccgcggtttttcttataataataagcgaaatcacggcgccagtatccagatttcgcgttatcaatacacagcacaattttagtgtatccaagagtttttgcttttttgacattaaacttaattgagttcaatatcaaatgacgaaccattgataaattaattttttctttatctgggaagtttacaagagcagttgaaagcgcaatttgactaaagtcaataaagcaaattccttctttataatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggtgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttggtcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataaccgtttgtggcaaatgtatatttctgattatagcagagaagctgcaattgttactccatcgactgcatatcaagcacaatctaatgattttatcgtacgtagatttacttctgccgcaccgattaatgttaaacttccaagatttgccaatcatggagatatcattaatttcgttgatttagataaattaaatccactttatcatacaattgttacgacatatgatgaaacgacgtcagtgcaagaagttggaactcattccattgaaggccgtacatcgattgacggtttcttgatgtttgatgataatgagaaattgtggagattgtttgacggggatagtaaagcacgtttacgcattataacgactaattcaaacattcgtccaaatgaagaagttatggtatttggtgcgaataatggaacaacccaaacaattgaacttcagcttccgactgatatttctgttggtgatactgttaaaatttccatgaattacatgagaaaaggacaaacagttaaaatcaaagctgccggtgaagataaaattgcttcttcagttcaattgctgcaattcccaaaacgttcagaatatccgcctgaagctgaatgggtaacagttcaagaattagtttttaatggtgaaactaattatgttccagttttacaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtagctgaaattgctacgcagcaggaaactaatacaggtactgatgatactacaatcatcactcctaaaaagcttcaagctcgtcaaggttccgaatcattatctggtattgtaacttttgtatctaccacaggagctactccagcttctagtcgtgaattaaatggtacaaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacgcaaagtgaagttaatacaggaactgattatactcgcgcagtcactcctaaaactttaaatgaccgtaaagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattggataatgttctaataactcctaaaaagcttttaggtactaaatctactgaagcgcaagaaggtgttattaaagttgcaactcagtctgaaactgtgactggaacgtcagcaaatactgctgtatctccaaaaaatttaaaatggattgcgcagagtgaacctacttgggcagcgactactgcgataagaggttttgttaaaacttcgtctggttcaattacattcgttggtaatgatacagctggttcaacacagccattagaatcatatgagaaaaatggttatgcagtatcaccatatgaattaaatcgcgtattagcaaattatttgccattaaaagcaaaagccgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactacatcgggtgatcagactggtggatttaatggattacgtccattgtccattaataatcaatctgggcaggtcacaattggtgaaagcttgatcattgctaaaggtgctactataaattcaggtggtttaactgttaactcgagaattcgttctcagggcactaaaacatctgatttatacacccgcgctccaacatctgatactgtaggattctggtcaatcgatattaatgattcagccacttataaccagttcccggggtattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcgggaccatatgttaaatttcaggataatcccgttggaaatcaaacatttagcgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatatgaaagtgtcgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgcccaagcaggtcaaggcggcatgagaaatttaagcttttctgaagtatcaagaaatggcggcatttcaaaacctgccgaatttggcgtcaacggtattcgcgttaattatgtctgcgaatcggcttcacctccagatataatggtacttcctacacaagcctcttctaaaactggcaaagtgtttgggcaagaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaaccacaggcagctgataacgatttcgtttctaaagctaatggtggtacttacaccggtccaattactattaattacggggtaaatagttatcttcaattaagtaataatgaaacccccattcgaattcgttctggtggcggtaccggtaatactcttgtagttggcggctcttccggcggtattagttttagacctgcaggtagtgaaatcactactggacaaattactattacaccagaaggtttgacaacatttaccagggctgtaacggctccatcgataactgttacatctactccttccgcagcatctgatgttactcgtaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctattaatttaaaagataaaacaattttcacaaaagatgactcaggcaatgttatagaattaggtttaaaatatggaggaactataaatggatctttagaggttacagaaaatataactggaactttaattggaaattctagtacagctactaaattgcaaacacctaggaaaattaatggtatatcttttgatggatcaaaggacattacactaactccatctgatataaatgtaaatagtacaacatttataaaaaataacggcgaattacccgttgatgctaatttagatacatacgggcccattgaagaatatcttggtgtttggtcgaaatctacttcaacaaatgcgcaaccagcaaataaattcccagaagaaaatgccgtaggtgtactagaagtatttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggagaaacagttcaagagcaatcgcatcatttgatcgccattatccagaagaaggatcagccgcacaaggatttttagaaatatttgaaggtggtttatacacaagaacgcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcctgggttatataatattttaggcactgatgccgttattaactgtcctaccggtgaaggtttgccgactgttattgttggtttgctggaagttaaacaacgtgcttctggcggtgctattttccaaaaatttactactgccggaacgggtgcaactactcgcgatcgtatttttgagcgtgcatatactggtggtgtgtggggtacatggaacgaagtatatacatcttactctttgccaattactttgggtatgggtggtattaaagcccaattagcggagctagattggcaaacatttgattttgttcctggtagtatgtttagcgttcctttgaacaaaataaagaacatgccagcaaatatgaattggggtacaattgacggaaacttagttatgttttctgtcggtcctagcgaacacaccagcacaggacgtactgttcaggtttggcgtggtactgtatccaagacaaactaccgttattttgtcgttcgtgtgttcggtaattctggaaatagaacttgcacagttcgccgtgttgttcttgaagacggatcacatacttggactgctcaacaagattttaatggtgctgttaactttggtagttcaacaacgtttaaatcaactacaacatttaatacagaagttaaatttcgctcattgaatgcattccgtatgtatggcggaaaatttggtacatttttacgtaatgatggagagagtctttatattctttccaccgacgaagatgatcaagatggaaactttaatacaaatagacctttccgttatgaattaagaactggtgatgttactttgggtggtgctagtggtgctaacgttttaaaattaaaacgtgattctctcaccgcattttttggcggtgatattaacattaaaggcacgatgacttttgacgccggacgtttaggatcacgagattattttaaatttaaccattggggtgatagtaataatgcgcgtgataatatcatccagttagaagacagcaaaggcgctcatttttccactgaacgtactttagcgactggtgcaattaagactaaattttttggtgaaattgaatccgatggtaaattggttattaaacgtccgggtgattctattgtattatcaacaactgctagtaattctttgcatattcgcggtgatatagacgggactggtaactggtatattggtaaaggtggtgctgataatggattagcgttctatagttatgctactaatgctggtgtatacattacaaacggaggggatatcgcgctaagtccaaagggtgccgaaatggctcaggtcaataacgttcgattatatgttcatggtgaacgttggactgctagtcaaccaggtgattggggtcgtcagtggcaagtggaagcgccaatattcgtcgatcatggttatgttggaccagatagctattatccaattattaaaggaagaagtgtaatcaccaatcaagggtttgtaactgccgtcgatcttggtattcgtcgtgtcaataacaattggggacaagcaattattcgtgttggatctgcggaggcatcgccagcggctggacaccctaacgcgatatttgaatttcattacgacggtactttctattctcctggtaatggtaactttaacgatgtgtatattcgttccgatggtcgacttaagatcaataaagaagagttagaaaacggagcacttgaaaaagtatgccgactgaaagtttatacatacgataaggttaagtctattaaagatcgtagtgttattaaacgtgaagttggtattattgctcaggatcttgaaaaagaattatcagaagctgtatctaaagttgaagttgatggatctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagaaaattatggcagtagttggtgttcccggttggattggaagttcatccgtaaatgaaacaggacaacgatggatgagtcaagcagctggtcaattaagattgggtgttccttgctggatgagccaattcgccggacgctcaagagagattattcatactgtaagtgctaatcataattttaatggtcagtggttccgtgatagatgctttgaagctggcggtgcacccattgtattcaatattgttggtgatatcgtttcttattctaaagatgttcctttattcttcatgtacggggatacgcctaatgaatatgttgttcttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggaggatacgattacggtaacgcacactccggcgctggtggtaatgctggtgctgctggtcagaatgcatggtctgacggcggtaaagttcttaaagttggtgttggtggtgcgtctggtcatgcagtgtttggatcttctccaacttggggtgttgttggaacaatttacggaccaagagtataaagaggagatatacaatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaatgtgaataaatacccttaaaaggagggtctatggcagcacctagaatatcatttagtccaagcgacatcttgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtattggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctatgaattccttgaacgactcgcgttcctgagctacattatgctcgattaccttttcaagattatgactcattcgaaataatcttcaatttcgtaatcatggacataaatcattatagtttctaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcgcgtgtatcggtatatcccatctcaacaataaaatgccgtattagatttttatctttatcgttgagagaattaaaataatcggattttgaattaatttccctggccaatttgaatcaccttcagttggcgttttagctcttttatcatctcttcgttcatcgcaatataaagatcgcgtaaagcaagttttagcattccatttactggataactaaatggacatacataatcttttcctacgagctttttggtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaagataaatttcgtaagctgaatccataaaggaacttatagctgccatgaaattattgcgaatacctactggagcatctttactttcacgaataatcatgtatttgccagtcttaatctttacaatagttccaagataagccccatggtaccagatgtcccacccctcctgagtgggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactacgataagtttcaacctttttaagaacaaatccattttcatctaaaagttttaacatgaagtctttatcttcttccatatcagaagtaatctcgcgagctttacgagttgctcgttttttcagcagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttctaatctccgtaattctgtatcagtagttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagtttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatgacgttcttcttcattatcgctcaaagaatattctttgcggaatttaactttgaatccaaaaccatgctcaccgcaagcatcatcccatgtaatgaagcctttatcttcaagtgggtctaagattttactcacgtaagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgtaatacagctttcttaacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatatacgttatagaaatttttacttacacgagcaaaaatataacgacttgctgctgctttttggacggtacgagaaccaaagtttccttgaccatctaacagaggaaaattattattccaagtgttagccatcaaagcacctgcgtcttgcgcagagttttcaccatgatgatatccaaggtccgctacaccacctgcaatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctactaataaagcagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttgtttttaagattgttacgatagaactgcatcacatgttcgttatggaaattactcatacacaccacacattttgcataaacgttcaaaacagataaatccgccacctacacacatcacgacagccacattatcattaagaggtagacctaaagccgtaaagattccagtcaatgtgaataaggctaaaactaataggtaacccattacaaatagagctttcattagtatgcctgcaaaacaaatttaaagttatcagccaacatacggttcatttcttcaagtgtttgatactcagaatgatgattacgagtaaacgctaaagctaactgaccttttccaaatcctgtcgtcaaaggtttcatcttagaagcaggaagataaaatactgcatatggaacattgttatttgcaatagtacgcgcaagctgagaccgacgttgacgaatatgacttagaactgcgctgaatccttgcttagaacgttgattacctacataaaatcgtgcagacacacatggattactaaatggacgaccatctaatttacttactaaaaagtaaaatccaggtttagataaaatatctttatgcggagttcccaaaaaccactcaccacccttgattgtaccaataacagtagcacctgcatcattcagatcagtaacagtcatatatttcatattaatttcctctaaattattttctactccaaggccgcatgaatacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagttgatagggtaatagtaccacggaagaacagtcttgtaaacaactttttaaaaatattcgtaataaatgtgaataccaatcaccactgctgaaacctgtgcaacccaccacgcacaagcaataagtacagaattcaaaattttcataataacctcatcacaaaagtaaatgttaaacaaattaatggaatactaattaaccaaacgaaacaccaccataatgaactcatagttcaatctcagcaattttcatttcattactattaatagccgctttaagactatctgaaagaattacattccagtggtcattcatatgaccattaactaagcgtgtaatttcttcgggagttgaaaaataaggcgtatcagactcccaatgcgataatcctaagcgagtataaatcataccttcatcatcgctagaatattcaactgacacaaactcatcagttattttatgtttagcgtaataaaatttaaatttcattttccgctcctccgtagttgatagttgtatattaccacggtccttgtggtatgtaaaccgttttgtgaaaatttttaaatggaaagataccatccgttgtagttgctttttcttacaaccttacgaaggtcttctctgtcaccgatgaacttcggagtgtactggatgacacctgggtgaatttctttagtgttgaatataattatacagtcagcgacctgatgattcagaatgggccctagatttattccagaaccatatggatactctccgctgcatcctgttgttacagaaatccaacgtgagtcagtttgatgtgtcttaacttctacacgaagcccgcagtatcttggatgcgccaatacatcccatgcgtatgtatacgggtcattaacgtcctcttggcctttgttaacatacccgcttagccaatctgctacaaaaaactctgcgtacaccgcgatacggcatctttcgataacttctgccttatcctgatttgggttttgttttaaagagtatcttgctgtatcagcaattttgaccttcatttcactagtcaaatcactgttcgatagggtaaatgtcggaatctgaaatagtctctgtaaacccggattcgttttctgcatttagactttcctttttaccgctgagataagcgttatatactttaagagtgccgtaataaattcggtcattttcatctaaagactcacggtcaagttcatcgagttcctttttatccatgactataacatcattgcaataaagaaacccaagttttttgtgtccaaactcaaatttattacagtacacaatattagcgtgatgattaccatgtagagaaatttcttttatgtcggaatcaccgatattcatacaataaatcataattcaccttaaaacaaaagggccgaagcccttattttatttgaattgtgcaattcttttctctaaacagtcagcataagatttcattgagataaactgcgaaagtaacagttcttgctcaactgcactaactgttagaaactttgcgctttctaaaaatttgctcagtgcattaattttgagcattaattgatcgtattcttcttttactcgtgcttgataacctaacataattttccttagttaagggccgaagcccttatttaaattgttcagtaacgtcttcaactacttcgtattgacaggtacgcattttagcatcgttgtaatcaatcggaattgatactacatcacgcggatgtactttaacttttacaactcggctggttgaactgccaaagtgacgaatataagatttagaacacacatgcagaccgcgagaacaagtttgtgtatcatcgtcattcacacgagtacgtggcattttaactactttaccaggactgttatcaaaagtatttgaatgacagtcaaagtagttgtcacgaactactttccaagcatagaagtaaccatcttcggtgatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccagcttatccgctacaagcagattgagaatttcctggaagtttgaatgagtattaggtgttgcgttataagttacaccgtcaacagtaattgaaatgaattttttagatgcattccaaataatgtcagatttagcaactggagcaataactgcatcgctattaactttaactgtaatatcaccgctaatagtaactttagagcgtttagcttcttcagcatttttcaaaacacgacgaattgtgtcaaccgatacaccttgccaatcagccaattcctgttgggtgtaattaccacttgaatacaatttaacaatttcagcttgttcgtttttggtcaggcatttaatattgtacataattttccttattaggccgcaagggccttcatagttttagcgatttgggaaacttcatcatcatttaaagagttgcgataaccgatgaagtcggaaacaatacggaatttcttggtaaactcagcaaccattttatcactattttttgaagcattacgtgataattcatcaaagagattagttactgtccagatatcatgaccgatggtatcttttccaccattgaaatacacaccgcgtaatgaactaaccatattaccaagtcgtgtatattcttcagaaacttcgtctgtactgaagtacttcatcataaaatctagttcaggatacttgataattttatcaatatatcgttgagctgaacttgaataacctacatacttatcataatctacatcatcaaaagcatctacatataaatcacgcagagtttcaaaaatacattggcactgaccgagttcttttacctttttctgcaaaagcggacgaataacataaaattcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgctcattgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatgactttgcttaatgcgtttcagtcgagggtcaagatttacttcatacaccacgcctgcattgcataacttactatcaggttcaaacatactctgcatcttcttatatgacagatttttagtcgtgaatttgactgaattactaatcatataatctcgagcagaataccccatcttcattaattcgcgatatgtatgacgaggagatgtagattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccgttaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcagtcataatagcaatattatgataattcaagttttcagctttttcaccgagaactaatccagtgattgcgcaaatatcaaacaattctttgtttttaagcatatcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcattagaattgcttcattatttagaatagcacgtgaaatctttttagcatcaagttgaatatgactacggatttcgccaaatggagaagtcaaacgctctttagtttgagaatcaaatcgcatgtttttcatatcacggacaaacataacgatagtcaaacattctttaacgcgtgctttagtcacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagagcaattttcttgttcttgaacaatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacggatagtcgaatccttgaagaatagaccagaacacacggttccttctactttctgcccagtaggtccaatagcacgaaatccagtatgttggaaatcattttcagagcaaccgaaccagttgtatccagtgatttcaatattagtaaaaccacttgaagataaaactttggttgcattatcagcatcagtacatcctgctaaagacactgctaatactaatgctgcgatagaacgattaatatatttcatagttttcacttaaatttaatggcttgaaggagactaataattctcaagcgacttctttcatctttaaccgtaaatgaaagagggtcaccagatttcatagtgatagtgcattcaaaatcaaaaccttcggggacttcttcgaataggtcaaattcttcatcatatattagaacattactctgaaaactgtgaagaatttttccatcatttccagatgctgtactaatcattgtaacattattacctttcatatcttcaacgataaattcgcttgtagatattacggcattaatagaaccattcctataaatagcagaaaatagatatttcttttcttcaccttcgcgaatgcgatatttcttaccaattttaaacataattaccctttaagtaagtcgtaaaaaccaccattcacatgcttaggagcggaaactaaccgaatagcaatccgatgacaatcaggacatacatcagtatccctttcagaaattttcttgattttttcgtattcttttgcacagtctttggattgacatttataatcataaagcggcataattattccttaaagtgtgctttcaacatctgatacaaggaccatgcttgttcattattttcaatagtaacgttcataaccgggaattcagatggatcagttattgttgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttagaagataattcttcccgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacatgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcagaatatctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccatcgatggtgcttacatcttcatctgatggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttccttgctaaatcgcgaatttgacctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataaccgccttataaagatggctaatttcacctaaaatgtaatcactgattgtaacagtttttacttcaccacaaaagaattctaacgcaatcaaatctcgttcaatttcttccaattgaagcattaacttgcctgattcaattttcacgtttttgcgatttttactataagctatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatagcctcacacataaaacacatcataacgaccacgggtaacaccaacataaagaagttgttgggccaattcagcatctgcataatgaatacaaggcgtataaatgaaagcacggtctacagacataccctgagctttatggaatgttgatgcaggaagtgctttcactttactaaactgtgatttagcatcccaaaaatcactccatggagcttttccgcctttgttccaatttttataagtttctgctgttttacctaaaaatagattaaacttatataactcttcatcagatgaaattattttaatcttttcacgataatattcatcatcgccgtaagtttctactgttaaatcccaatgacgaattagatattccccaggaacaccacgagctttaacaaacgttgatgtatactcagcttctataatacgaactaattgtccgttattaaaaataatttctgatacaggctttccatcaattttatatgttttaattaatggttcctgcattacaataatttcaccaacaataaaatctttatcagtttcaaaaatctttttacgaataatgctatttaacttatcaacagatttattcgtaaatgccattacgcgattttcaaacaaatcatctagtgatttgacgattgaaaaataatttaccataaaatcgcgtaaagcggtatcaccggtaaatccacgtactccatgcccgtcaacaactttatcataaatccacttaccgttacgaacatcagtagctacatcaataataggagcattactgcgtttaacttcagtaagttcacactgataaaaatctttgtgtgtaaagaatggactgatataagcagtattttctcctgggtcaacaggtctaatttgcttattatcacctattccaattatggtacaccatggcgggatagttgaaagcagaattttaaatagctttctatcatacattgacacttcgtcgcagattaatactctgcatttagctaaatccggtacttctttttgttcaaaaagaacgttttcttcatatgttactgggttaattttaagaatgctatgaatagtacttgcttctttccctgatagttttgaaagaatctttttagccgcatgagtaggagctgctaaaataataccagtttcacccgtagatattaaagcttcaatgatgaacttagtaagagtagtcttaccggtaccggcaggtccattaatagttacatggtgtttcttttctttaatagccttcataacaatgttaaaggcatttttctggccttcggtcaaatcatcaaatgtcatcgtaaattccctgcaattggtatactaacaatacgcccagtatctaaaattcgctgatataatctttgtgtgtctacgtcgggcttaacatgtttaacttctattttattaaaccaaaacttgcgtggagtctcaactaatcttggaattcccttacctaaagctaatcgatactgctctttaagagtggtaaatactttatcagcaatcttccattcaaaaaatacagcaggacgatgttcatcaagtggaactggcgcaataaatccatctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataatccttagcttaatgtcagaggtttgttttgatttagaaagctgtgaaatgtgttcaattcggttttcacgttttttctgtatagctttaatttgattataggtctttttgattttagcccatttcttttcatctaaatttagtttatgaacttttttcgcagatgaacgaccaattcgcaaagcaaataaatcacgcttttcaatcaactcctctaaagtataatcagaacgaaatgtattatactttttctttactgcaataacattccctttaatgtatccaatgttattatcaaaacgttctaatgataatttctctccttcaatacgattatcaaaaggttctcctgagtaagcgcaaactttctgatctaaaatgttcttaatgtaattgaagtctaagttaaaatctttagaacgtcttttagcagatgcctgagtgtgctctaaacgacgtttaattttacgaatttgattattagacagtttcatatttttctcacatcttacggacgatttaatacttactataacatttttacttcagattgtaaacaactttatgcaaaaatgctttaaaaatttcatggtataatgaatctaagtccttccattatagattaaatccttcaaagtcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgtagagcttttatagcatactcctggaaattgaataccataggagctttgaattcaaaaataacctgtgtgttatactctaaaccggaagcaaaatgtatagctatatttttatcatatgaagctgatacgactttatcaaatgtaataatatcaattccttgatttaacgcttgcttagtctcgactggaacacctctccaaagaggtttatcgtttggaaccaaacgagatttgactatttcatttaaccaagaatgatcgtctggtttattagtaatacaatgaattaaaagttcaatttcagataaattaaatccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattttatactttccaattggaatcatccattcttgttcacgtacaatcatcattaagttatcagtacgttctgaatctaatccatcagtatcttcatatgtatacttaaattcagtattaggagaagaaagtataatatcgctgatatggtcagaataattaaaagctttatcagtttttaagcgaaatattatttcagtgaaatactcaacataagaaaaaccacatgctgtgcgcaaactagtagtaaatgaatctactctgttcgttgaaaacacttctccaacttgtaaatctttaatgagttcttttgtcgattttgatataccacgatatagctgataaggcgatttagttaaatgctttttaactattttattcaactgccgatgaagagcttcattctttttggcttccatacactgccaaagaactgactgttcaaagtcagtaaatttttcacagacctttttgtacatatcatattgaaaatcgacactttcagcttttatagataactgttcaacatctgcgagattaataatcatgatagcctccatatacttcagaagctatcatatcattgttaggaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaataacgattagcttcaataatctttctttcttcttcagatattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcaacactaatcattgatttcatccattcttccgattcgttctgcatttctttatttgcttgttcaacccaaccatcatcaatatacatcgagtttggtctattgaaccattcaagcatcttcttcagagctttcatttgttttacctaaaacaatagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataactcttatcaatcattactgctacggtaattggaacgtctttagcaaacgacatactaatactattgatagacatttcaaacaaaatcgcttccataattttcctcaatcacaagatgtagatgaacaactagaatcacaagaactttcacatgaatcgcccgtccatacatgaacaggaacattagtatcatatgaatcagaactagactgtgtattctgtgcattagatgatgtagtaggtactgaccagcgccaaggatttttataatattcttgggcttcttcataagtcatagtaactgcttctactgttccatctcccatataaacatactcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattaattttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctctttcttctttttaggaatctgttcaggacctttatttactacagcgcctgacgttgttccagtagagatattttcaggattaccacctgaatctccagctaccatatcttctttaataaattctttatatgttttcatattaacctctattcataaaagcattaaaaatttggtcatcaatagatggcacagtaatattttctgcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacctcactattaaaacgtggttcatggaaactgtaataaaccttttcatctataaaatcgtatgaaattttttccatttttaaatatgaaaattcagaactatacatattaacctttattcataaaagcattaaaaatttgatcgtcaatagaaacatttactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaatattccaccgacatactctgtgctgcgtttaaagtttacacgtttcctaaatgaaaaatattcaggttctttatgagcccgactcataggacacaatgagtagctagaataagagatgtcaaatcctacaccttcaatatgagccaacgcgtcatgattaaaccaattataatcatatgccaaatccattatattgtaatatgtgaaaggcaccggattaacatcatgtgttgtacctttaaaatctgcccaggcaacgatttcgttatctttaacaattacaaaaattgtgtcaataagatatccacggttattttcatcaggcgttatattataacattgcgcatcaggaaatttaccgtatttaaacggtggatttttgtgcatataataaatcatattattcacctgtgatttcggttacgatatttttgttattaaagtttttatcgcaatacagaacataattatactgcattacaccaccagacttaagttgtttttgcactttagctttcatttcgggacgatcgcgctcaacaatattcataatatccgcttcaatttgagtttcaacttcagtctgatctgcagtcatagaccattcacacaagtctttatcatatcctgccatagcaggctgagcagcacaagaagccaaagtaaaaattgtagcaaaaataaattttttcatgataatctcctcagtagtttatgtttatatagtatctcaatttccaacaaaagtaaacagctattttaaaacttctgcataatcacatgttacaaactgtttctctagcttaacgattttacgaaaataccttttatactgacgaatctgcctcttcgtaggacgtacagcaaacttaataaattccactcgaccaaatggaggactttcttctgctggaatatctaacaccaattcccacgtatccgcaataagtgctttgaattgcgtatttttcctgacgttatacggagtaggtttaaataaaacaatatgcatattatcctcggtaatctacttcacatactttcttgtcatcaatgaaagctttaactagtgctttattaacttcagcatattgagtagtagcccattgaacgtcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgatcgaaatgtattagcatctgctccaccagtaggatactgtttaacgattaaacgaccgagagtagatttctcacgccatttttccatttttcctttatactcagcgtaagaaatatgcccatcatcaatgtcatcaagagaaacatcaagcatattagcatcaatacgtttagcgcagacttcttctgccatttccatggaaatgtaaagaacattatgtccgagctgtaaataatctgctgccaatgaacacagacctaatgacttaccaacgttaacgccagccattaaaacgttcagcgttccagtttcagctccgcctttagtaattttgtttagaattctgagtttaaatggaaccttacgagctttattcatataagatagccaacgtgcttcgtagtcatccatccaatcatgaccaacgtaactatcaaatgaaattgataatgcttggcgcatgatgtcaggaatagcaccaacatccggcattttcttatttcgtttttccggaggaagctcagcattagtttgaatttcaattattttagatgtggcgttaaacatcgccctttgctgaacatatttttctgtttcttttactaaccagctgtggtcttccggagaatcagccagttttgaaataagtgtttttacaccagaatattctgtttcagtaaatgaactattttctaatgcaacatttaacgcattaatagatggaacgctatgatactcgttgacatgagatttaattaatttgaatgtatttttagctggaccactttcaaaatattctgaatccatatatggccaaacttttgaaaaataagcttgatcaaatataagatgagaaagaataatttctaccacacttactccttaaaagaatttaaactttttctttgaccttttattaaatgcatcttgtagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcggatttaattatcttaagagattcattaaaaagacgttcttttctttcttcttccccctccgaagagggggattcatcgataatttctagatctaaatctaaatcatctttattcattaaattcttccatatcacttaactgctcgaggtcagtttctaaatcagcagctgatttacttttactttctggagatttaaatttttcaacctttgagttaatcaattcatcgacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcaccggtttcttcgtcaagaaattcacgagcataccagccatttttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttccgtttctttcttagaagccatattaccgattgagtcgatgaatacaataaccttttcaccacgctcaatagcttcaagctggttcaccatatcaattttcagttgttcaactgactgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaattgcaccagaaatagcaatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttgcgcgaaacacacatgcgaagaacctttaatggctcgtcttcttcacccaacgattttcgtttttcaatattagaagttttccaacgagcttgctctggaaactctctattgatttgctcaagagctctattatgttttgaattactacgaattgaactgcacccgcccggagcctgtgcttttccagatacaaccagatatttgaacaaggccaaatgcggataaccttgattaattaaattgagaaatgcatacatatcttcgcataaatcaatttttccatacccaatttgttctgttgtaagttttccaaggtcataccaagtattcgtgaatccatatgaattttcacgataattaccccaagatgaagtaattttaaaaataggtagacgagcatggccatgataataaccgcaatccatggcatctttaacgtattgaatcaattcatagaactgttcacgagttaattgattaattttatctacacagcgacgatcatctttctttcgcattgaactcatacgaatagtagtatcatcatcaatcatccaaattcgttgacctgcatacatatcagtaattgctttacgagtaccagcaattccgttaacatcatcaggaatagttataattttagctctagacccgtaagcgtcataataagctttttcttcgtgttcacgtactacaatatgcggttcataatcagatggaaacatatcaagggcagaaactgcccctacgcgttgatagcttggaattacgaattgaatcatttccactcaccgttataatcttttttcgcaatatgtgtttcaccagttttccaccaatggtcaaccaaataaaaatgacgggaatacacatgaaggctcccgacattccatataatggaacctgctttatactgacgagttgaatcacctgcattcaaatcagatactaatttatctaatacgtatttttgccatgcataatcattacggaatccgaagaccacgtcatttgaacgcatgcttactactgcattgactttcttatcacgaatcaggtactgtactgtattcgtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaaccccaacctaaaataatagttggaatcataagaggaaccgttacactatagtatatacttattataatcatcaagattaaaagcaacactgctataattttgcttttcattccttctctctgatgataattacctgatttggttgtgcagactttttagtttcacccgcaattgaccaaataaatgtaataaaccaaccaataattgaccagttaaacagtaaagacgtgaaaaagattcctactgttgattttgacccacgcatcaaggcgatgaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccagtacgccattggtaattattagcccaattagcccaaatttcggcgcagtagttttcaattttttcttcgcgtgtaattacatcagaattacgatatgcttgagcagattcatctggacgaatagcttcgtcaaaatttgcctgcatttgttctactgtttgctttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagatttaatcacaggttgagtatcattttcaacactaacaaatggaactgctactaatgcaactaaacaaactgctaagcatcccataacaattttcattttattctccaaatctgtatcagtagttgatagttgtatagtaccacagaggaacagtcttgtaaacagttttgtgaaaattttttagggaattctaaaggtccaaaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacgggcatttaaatcctggccaacctttatcatcatatttcgctatatcgttcgcagtttttacttcagcaataactttatagtcaagttgacgatattctttctcgaagttcttgtaatattcttggacagactcttcaccttcttgaagaatacgacgaatactttcttcgagagcttcttgtactgcttttggtgttgaactctgctgagtttccatacccatgatttttagatgtggttcagcaaatcgcttatcttccatatcataaacgttcagagcataacgttttttcgctttccaaaatccaccaacaccctttgaaccaagcggaggacaagaaatagcttcacggtccatatgcatcagatgctcgcgattattcatataatcacataactcacgatatgcaacatcaatcataggttccatctttttcttaccgaactgattcatgaattcaactaaatcattttgttctttaaagcggtcaagacctactttttcaataactttatctacacaaacatataccgaatcagtatcacctgctgcgatgaaatcttcaccattagttccacatactttattnagatattcattaattttacgagcaatccactgaataccaacttggccgaaaattgtgatagcagtagcatttcgcaaatcatagtaacgaaaatgaatattaccaagagcaccgtaaagactgttaataagaattttacggttcagctgatttgtgttagcaagtgtagctgctttttcacattcttcaatcaaactattgagaacagattcggtgtaattcgatagttcatttaagaaatcatcactgaacttaacatatcgttcaacttcaggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgcccacgaatagtctcaggactaatgttaacctgacgaataatgctcggatacagagacgtcaagtcaaaactcataatatatcgacgagcaattggtttaggttcaaacacaaatgcacccggaaaactctgtttaacgtgcgaaccctgttgaggaataaccttatgttcacctttcaatgagttaaaaataatggcatcccaggttttaataggactcattacaccagaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgctgagcaactgattccaaagagaatgacggcaaattagtaaatgcgaatttcttatacaaatctaaataatcaagaatagatacgccatcaatagaataaatttctttgctaccgtacatattttggataagtttagattttactcgaccgattggagagaagcgtttcatactacgttcaccgagaaccattttaacgcgattcatgatatacggaacgtcaaatccctcaatattccaaccagtaaaaatagcaggtcgtttctgttcccaaagattaatatattccatgagcatatcacgctcattatcaaatggcatataaattactcggtcaagaatttcttgaggaacttcatcaccaccttcacagtcaagcttagcagctaactttgcatcccattttgatactgaaccatacattgaattcaaaaggtcgaaaacataaaaacgatcgtcaattgaatcataatgagtgatagcatcaatttcatattctgctttcattgggtcaggaaatttatcaccagtaacctcaatgtcacagttagctacacgaacaaattttcggtcataaacaatttctgaaccatatgtatcactgatataagcgagtttaaaatcgttcataccgagagcttcgagaccgatgtcttccattctcttcatccaatctcgagcatctttcattgatggaaatttttgaggagcgcagtttttaccatagatgtctttgtactttgactcttccttacaatgcctaaacatagttggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaaataaggggccgaagccccttgcttaattaccaatcgtatatttaggaacgagtttccattcatgtttttgtttaaaagaaataactcggaagttattagttaaatctttcataaaagttctttgaccagggacgatttcaatcagtccccaatcttctaacagccatgcaatcgaatcacgacgaacttcatcttcttctgtcatttcaacttgacggccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataccgcttagcaagtaacttaataatcaatacttcggtggaatcttcaactagttttgcccatttaccatatcttttaccccgaggaactgcagccattagataattaaaatgagcttcatcacttaatccagaaccgattaaattcatagcatatacagctggcatgcactctggaaattttgataatgcattttcaaccatgaattttgaataatctttttgagcaatagagcatttagttttattattaatagctccaattatttcaaaaaactcattttcagctttttctttaaaagaatcagcagcggattggacagctgtccaatcttttgaataccaagcaacttgatgctcgtttaattgaatatcatcttcaaataagctcatatcacttccactgcatttcacatgctaactgaatgaaaagataagctaaatgcaattcagtattagctgcaataccatgatactgattattttcgccgacaatttcgtacatacgaataatactctgtggagttacacgtgaatagatttcttcggcaagtttaccaacaaaccaagaataatcggctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttgcagatttcagttaatcgacgaatcatctgcttcatcatttcaattttatcttcatcagttggttgaccgaatgtaataactcgacagcgtgactgaagcggtttaataataccatcaatattgttagcagtaataataatactacagtttgagctataagcttccataaaggaacgaagatgtcgctgagactctgctaaccctgagcggtcaaattcatcaataacgattactttttgacgaccatcaaatgaagcggcgctggcaaaattagtcaaaggaccacgaacgaaatcaattttacaatctgatccattcacaaacatcatatcagcatttacatcatgacacaatgcttttgctacagttgttttacctgttcctggagaaggagaatgaagaataatatgtggaatcttacctttacttgtaatagatttaaaggtttttttatcaaaggcgggaagaatacattcatcgatagtagatggacgatatttctgttcaagaatgtgttctttttcatttacggtaatcataatttcctcattcaagttttagtgtaaatttaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgtgcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcacgagtcataataaattgaccggatttaagcataataccggagttaatagtagcgaaatttttcagcagagcagtagtatctttagacagtttcatgtaatttccttcaattcaaatgagatttaattttataactaatttaataaagcaattaacgattaaaatcagccgcaattgtttcagcaacaatttgagcagcaacaattaggcgttcatctgcattaccgcaatattcatcttcaaggcgttcaccacatgaagtcataataaatttagcaccggcgtttagggattctgcagtatgtttgcgcattagttcaatccatttattacttacttcacgatcgatagcttcataatacgcatgacgagcaggtgcagatttaattttgttctgaataacttccattgcgttatcagaaagagacaaaacccatgcgcgacgaattttattttggttttgtggatttgattcagaacgcacgtgttttggctgaatatcttttacatcaacagtataattcacggtaattttagtcataatacacctttagtcataataatcagtaacagtccaagcttcatttctgttggacattattttcgtatattctgatttaaatgcattcttaagcatagattcagtaactatatgctcttcattagaaaaattatttctcagaatatatcgttttatttcaggaatagttaatagatgctgtccagttgaatattctgccacagttcctccgtataaatatgtttatcactcgctgtatcaaaaggatatgttatgaattataaactaatttatgaaaagttaatctctaatgctaaatctcgaaaacttgattgctatactgaatctcatcacattataccgcgctgtttaaatggaagtgatgatgcttcaaacttagtagatttaacaccagaagagcactatgtagctcatcaacttttagtaaaaatttatccttctgaaccaaaattagtctatgctgctaacatgatgacagtttctacgaaatacgctaaacgcaacaataaaactttcggttggattcgtcgtaaactctgggaaatagaaaagaacaaagaattctcccaggagacacgaaagaaaatgtctgatgcagtagctaataaagcaagactaacttgtcctcattgcggtaagtctggattaagcgggaatatgaatcgttggcattttgataactgcccaaatcaccctaatcctaaagttagaccaccaatgtctaaagaacacagaaataatatctcaaacgggcttaaagcaatcgttcttgaagaaacatcctgcgaattctgcggaatgataggcaagaaatgcgttatcgcagcgcatagaaatttctgcaagaaaaatccaaatggacgcaagaaaactgaaaagactggtacttgcgtccattgcggtaaagttaccactttcggaaatttatcaaggtggcataatgataactgtaaatataaacctagctaatcttagctaaactaaatctaccaactttttccatctgaatatgctgaccatattcttgtgggtcatggtctttatgcgaaattatgaagaagttggtatccttcaaaccatctaaaattttagctacatttttaatgccttcagcatcaaatgcaccatcatacacttcatcaagaaataaacaacttattttaacacctgaaactttttcagcaatatcacgccaagtaaataaaagagcaatatcaattcgtgctttttcaccttgactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcaatgctatttcatcagcatggtcaataaactcagaagatgctttttctatagctgctttaacttttttagctttatctactgtcgtgattagagattgctttttattgcgaatatcatttgccaacgactgctgggttttaatattatctcggtattcatcaacaagaacttttaaattatcacgatgtgttgaaagctgttcaaacgaatgcgtacattcagaaactttatctttaattttagaaacaactttatcaccggaacttaattgtgacaaacaggttggacataatccgccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgaagacgagtaaggttgtcacccgttaattttttctggcgttcaacgttatcattatatattttaatttgttggataatactatcttttttaacatcaagcacttggttctgcgaatttaattcacgtattagtgctttattaagcttatccatttcagctaatgttcctacctcaagcaggtcttccacaagctttcttcgtgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccattaatggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccgaatgtgatggcttctaacatagtagacttaccaccgccatttcgtccagtaataagagttttttgaaccttatctaattgaatgtcaataggatttccacctactgacattatattttgatatctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatatttgctatgaattcatcattaatgtcaaatgtcgaaaacttcacagtatgcatccttaatacaagatacagccatatctcgtaatgatttaggtgtgtcattatctaaaatgttgaagttaaaagatacagcccaatcagtgcagaccgtgacctttttaatacaattatcttcaacctctagcggttcaaaccaatattcaataatttctttatgcccaatatcatcttttacttcacattcaaaatgctgactcatcataacatttttaaattcatcaaaagtcattgtgttgcctctacatatagctgattcgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcaccggcagttagtgtccatggtgtcccaatatatctgacattagcagcctcagaaatagtatggaagtgaccagaccacacttctttataagtcttaaggaaatcaggttcaagaccgtgagatttcattcctttataaaaataaaatccattcagttcccagtgaccaacacaaaaagaagcagaagaagtttttatgtgctcgagaatttcaccagtattttcttcacacatccaaggaatcaaatcaatcaaacacccgtcaaaatctactgtagtaggcttatcatatactttaacattaggatatttagccaaaagctcagtagaggcatttggatgcattacatttttgtagtggagatcgtgatttcctacaatagtatgtagggtaataccagcatcatcaagcatttgaactatttcacgagcaaactccatagttttatgcgtgatcgcttttcgcacatcaaaaatatcaccgtattgaatccataccgtaattccatttttcttagaatattctatcgcttgcttaattccatcaatttgaataccgcgaatccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcgcggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccattcttaataaaccaatcacgttgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataggaatcaacccacactttcatattagggtctgctcttacaataggaggattaacttctttaattgaactatcatggtattctttttcagaaattttcacgcaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgttttagaatatcccgacttttcttgatagcatattcgtattgagcaaaattattgttttcagctgcagtctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacggctgtcatagacattgtgaacgaaataactatatttctttgcaacttccttacgttcttttttaatacgttggacgaatgcattaaaacaagcttgagttatatatgcatgtgggtttttatatttcgtttcatcaaaattatgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacaatatgcttggaatactttctccatcatctttttaaattcatgaatatctatataatgactagttaaatcagcatgatataaaaagtctaaaaacttttcatgtgtgctaacgtattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattgatcaacatattcaatcaattcgccgtaattggcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcgcccttccagccttcgtacatcattgcgactgacaatgacaaggctccttcgcatgctgcatacttattattccagaaccaatttagaaaaacttcgtcctcaataccattgtgtttcatgttctggaaaaatttggcgcgttcttcacgaagcttttgcgataacatagattcaggattcatttaaattttccaattaccgttttcatcaatgaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaagtattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggtaattcatatgttaataataccacagtttgagctcgttgtaaacaactttgtgaaaattattttagggaatgataagaagggaacgatagcttagaatggtaatatacagaatgtaagaaagaaaggcccagagggcccgccttagtcttctatgatatctctatcatatccaagtgaaatgagagtttctttgaagtgtttaatgttcttttgtctagaatcattgatgaaaatgactggataacgaatgttaagagatgtgaatccagcgcgtttagcaagagatacaatcagtggacgatcatactcaatcttaccattatttgtaagaactttatagaaagtaaaaggagcattaagctcctttagaagttttgtaactgattgacatccaggacaacgacctacttcatctggaattccatagacttcaatcttattctttaagttcgagttttgttccacgagaaataattccttgataagcccagtatggcgggttaacagaatcatcgccagaattttcttcaggaaaataaacctggataacaaatccagatgcatcaaaggtaaaataaaccgtaggtaattcacctaacaattcagcgcggttattaatttcttcaagttctcgttctcgtccagcccaaaaactaggatttagactacattcatagaaataatagtcattaccgaacatatcaaaacccttccaactctctaccacatatcgctcaaaactaatcataattaggcctttttatcaagaacagcattcagtttgttagtaattttatccagacgctcattgaactcgctagaagataagcctttttctggagaaattaagctaatcacgaaaaatatagcaataaaaggaataagaaaaatagcaccaactgccataaacaaaaagaacgttacagttgtaagaaaatcagctaaacctttacgaaatttatacatattttacccttaattgattaaccaagcattgataagcactaaactatattgcgaataaaattctggaccaaaatgaaaaatcatatcatttatagtatccataatgtaattcaatttaatcatgtttccacaccccatcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttcaccagtgaatggaacaccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaatagccacatgttcttcttattgtgttcatctttttaggatcagtttctccacaaatagaacaaacaaatccgttttcagtaggagtcatttcatgggtacttccacatgtaaaacatttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaatccggttctttcagtccactgcttaagatgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcactcaagaaactgcggcaacccattggagaaacaggaatagatgagccggtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattcgcaaaagtcgttccgccgtattggtgagaagcaacttgcgcagtaatttgtgccataattgcagtagcaactccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttagtgtcagattcattatattcaaatcctctttgaagcatctcagccatcatttcctcttttcctaaacgagaaaattcctttgatttatctccaacaaagttagggtgaatattattttgggtgtaatcggattttaaataagtaagtaaattttctaaccattcaagataatcaacaccttgcccctttaagccagaacgattaaatttatgtttcatttgaccttctgcggcattgcagagattacaaagcaatccacgtacctttcctgcttttggtccatttaattcatggtcatgatcaagatgattagcttgaacatcaggatttagttctcgttggcaaattaagcatttaccgttttgtgcatcataaaatttctgtttttcttctttgtataatttgccagtcaataacataataaacccttaccttaaatagataagggtatttattattttcaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgccccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataacctttgctgtcatcaaagttccatacccataataaactgcaacttcatcacctacatataccgcgcttccgcggtaatcatgaatatagtcatttccttcgagcatcatttaaaatattctcgcagttggtcaaatccaccaatatgacttccatcaggagcaaatacctggggcattgttaagccgatttgagtatcacgacctagtttagtcagaagctcagcgattttctcatcatcaaaaacacctttttccggcataatgttgataaattcaaacggctgtttcttcacagtcaaaagacgttttgcattatcacaatacacacatttgtggatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcagtcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatacatttccactacgtccataatttttaacatcatgcggagtttataagacaacgaacgaatagttttgttgtgcttattaatttctttagctgtaatggcgccaagattacgtgagtaataataaggaacctggatattaattaatactgatgaaccacctggcttgtgtgttacttcatcagcaataacccagtccttaacatgaactgtatttgtacggtcatcgcctgcagtaaacagcttgcgagcatgcttaaaaagcatattcacttggtcattgaattgacaagcaaatttatcagcaaatttagtttcaggaatggtagataaccaatcagccaaatgggtctttttaacatcgttaacaatagtaaattcaaccaaatcagttatagatgtcgcagatttaatgaagctcggcttcataaagtttttaatgttatcacgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaattatatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgatattttgaccaaacatcggtatagctttatcatcaataacgctattgaatgatttgatatattcgttacgagtcataataatctcctcagtagaaagtaagaacattataccacatccttgtggcaaagtaaactagttcagtgcatttagtgcattgttcagtttagaacgttgcttcgtgagatttttgactttttcttgtgctttttctagcatcttttcagcttctaacacttcattggtcgctttaacgagttcatcatctactgccttaagggacttctcaatcgcatccgcgtgccatttttcaacaggtttaagactcggattttcaataggaagaaaattcactttattgaatttccatgcatctttattacctgaactatacatccaaaatttaggatcatttgacgagtaattagataaatttaagttatcttgcacttcctgctttttctcttgcgggacttcgtcctttctcaaaaaatcgtatttaaatgaaacgatcatatcaagttcatatgatgttgtatctaacttaaatcgttcaaaacgaggtaaaatcttagattgaacagcagcaacaacatccatatacttaaatgcttctgtcaactgtgatttaagacattcacaaattgaaagagaatttttagtattaggcttaaagctgattcgcgcagttcgattattttctttagatggtcttacttccatttgaagagtataaccatcaaatttcagattctttaagttaatatcagaaccttttaatcgactagccgtagacaaaatttgctttaattgtttacggaataaagcaataaatctccattcaagacgataatgatttggattataaaatcccgttgatagatcaactttactttgaccaacgccttgaacaagtagaggatttttataatcaacggttttacagaaatccatgagctgttcacgggcagtcatttgcgtaatatatccagctttatcaaaatgccgcaaccattcagcgctattcaatgagttaaagtgaatattacgtgtaactttatcagggtctaaattattttcacataaaaatgttatgacattacgagtataactagcattacgaaccatatcttcaatttgagaacgagttttcatagtattccttaaaatttaagtaaatcgataattttaattaaattttcacgctcagatttagctttactgcttaatccagacaatctaaaaatttcatcgtcatattgttgaatagaaatatttagctcttcaatttgcttattaaaataatcaatttgttcagaatgtttttcgttactacgaactggtacaggttttgtaggaaatttagttaaactggattcatccgggcgataaattaaaatgcaatttgaaccaatcgggcatttagcaccagatgaatattctaacgttccagcttcttttaaaacttcaaaagctaaacagagatgatgccccatattaacataatctgtagagcgagctctgatataataatcatcgccgcgaatactaaatttaaagcatttaaggtcttctgtattattggtcttaaaaatcatttgtttatctagacctttagctaatcgagcgcctaatgctaataatcgtcgttgattttcccacaaatctgcgatcatttggtcaaatgataatttcggcattaatcgaccataaaggtcatatcctttattataattgcgaaggatttcactcgcattaatacgagacaacgctccaattttattaagggctttcatgatgcgattagataaacccattccagacccgtttgttcgttgtaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcattcaattttttattaactaaagatttaattactgcattgacattattaattactactgacatatttcctcactcaatttcaattttactaaatacgcagaatatgatggaaaagactatataagcaccgcatacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttataagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgataaactcaatatcttcttgagttacacgagataatttagatgctttatcctttttgtactgttcgttagtatcacgagaccagtgtaatgtacgatttttattcgtatttttgtaaatttctacaataccgatctcatcgataataacgatccaattccaacgggatttgtaaatttgtcctccatcaacagtgatttcacctccgattgagatgtcattaaagaacttgctttgcgcttcagatttaaatttaccatcgttgtaatttactaagttgaaaatatctttagcgttcattttctgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatattcccaatcatttgtccatcgcatcgttgttgcgaattgaagtacagcttctttaattttagtttcgtaaatttcacgagcctttgagtataacatcattacctccatttaccagtttaattctagtcatctttttgatggcagtccatataatctatttctgaactgcctttttgtcatagaagtcctcttatgaattatttcagaagagtaacctcagcgatttcttcccaaccgtttttgtcggtcataataaagtcagcaagataaagagcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaactgagcgggacactaatgcttgtaaatgtggagcaagtttagtaccacggtctaattcgcggtcaatatcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaaagggagcccgaaggctccctatcatttataataacttcggtggttttcaagatagaccttctcaaggaagtcatcccagaaactcatgtctactttttgctgcataccgttcttagaagcttcagtagatgatgcttctacttgatcgaccacatcttccaaaaactcttgaactgttttaaatggatgcttacccaacttcacgtcgagaataaatggagcatcttggagtggataaatcaagtcgccagttttgtaaatttccaatagttggagtccaccacgacaagcatgactcaaagctttccagtcaataccttcattggcttcggccttacgagcacgttcaccatattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtgcgacgctgcttaatagaaccatcttcttggtaatcaatccactgctcagggatttgattaactactttcaatacatcacgtaatgcagccaaacgagaacctttgacaccgtatttagaagcttgcttgcggacatatcctaaatatgatttcatgttagtcgtataaaaacgagaacggttgtcttgaataaacttccacacatcaggcaaatcagatttaaccactagttcaggtggagtgtgaagcatatccaatgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgatgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaataagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatgaataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataaccttgccaacttgtaaaccattaaatgacgttttcaataaaattctgaagctttgtgtgagcatcaaccatgattttcatttcttcctttgcgaaagctgtacctctttccctagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccatcgtatgagtatccttcacaatgctcaactgctaattgatatgaatctatttcaacatcacgtgctaatttaataatttttcaaactgttcacgtgttagcatacttaaactctcgtattatgatcgataatttcatcaagaaacatatctaaagcttctacagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgtgatcaatcattctaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcacgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcgtattcacataagctattaattcgttttctttcttatcaaaccgatcagcaaattcttcttgctgatcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatattgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcaattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaagtattccactttttagcatatcgttttaacaatgtatcatttttatatctgcttgatttatctctttctccgtctttatatgcatatattaatttctgcgcaaattcagcttggcatgctttatttttcccacaataatccgcggcagtacggtttacataatctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagaggatatcgcctttcttatatcgcccttatgtatatttaaccaataagaaagttcaatgtacgcccaggaagctgaattggaccgtttattcaacattctttttatttcagcatcggtcatattataaccaagttccttaactcttgctcgcatagtaggcaaataattttggaacattccataggcatgatgctttggtttagattttaaattaactccggcagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaactttgcgttaggtttacaaactgtaaatccaagccaaagatttccatctgtgatttctaaacgtccaggacgatattcaaccccctcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacgctgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccaatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcgctcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacaggtactaataaaagcggaactaccaatggaagaattagtgttgctccaaatattgcaccagattcaatatcagtcataacgtctataaccattccagcaatcaccagaatcacaaatgatacaactaccacaggacctattaacacatcagtagaaattagctgacgctttggttcatacttcacaggtttacttggaaggtatagtgatggctttgacatattctttacattccttaacaaatttttctaataataaatcgctttcaaaattgggattttctacgaatttatcaaaaagatcatcaacaatagttaagatattctttttactaagaatacgcttattttcatattttgtttcagagtcaactataaaagtaaagaaatatttctttccctgaaattttaccgtagtatcaatataaaataaatttgatttttgtaaattacgtttaaaccatgcatcacttaaactataaacgccaagataatcataatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatacgtttaagagcatttagtaattgatctggaacatcaacctgtctttggaactcttcaaacattgaattgaaatcactttgcattttcattcctatttactccaagtaataggggccgaagccccttatcattatttcagagaattaatatattcctggacatcggcagaggtagtttcaaccccagaaatattgccgttaaaagtttcaactcgagcaagggtatcttcaatatcaaccttagtcagtgctgcaatttcaactacatcatcggcagtactaattccaagggcatttgccgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcatcaagttacaggctcataatatctcaatcatgagcctatgtaaacttatttcatattattaaaatattcttctgcgatttcgtcgttatcgtggtaaactttagaagacagtttaacataaccttcagcagtgaacatattaatcacaacctttacagtataccactgtccgtcttcattacccattactgcgtaagtttcaaacatcggatggtcaggaccgataactttaatatcattcactgtacgaccaaaatcttctgaaacgcatttcataaagaagttgaacagttcgccgtaattatccatttcattctccaagttgtttttctgtatcagtagttgatagttgtatagtaccatggaagaacagggatgtaaaccattttgtgaaaaaaatttttaaaagttttagggaattctagggagggatgggcaattaaaggataggataatatattataaagggtataaactaaatgatgcctagagaggtccagaaaggcctagataccaaaaagccctatcatttagatagggatttaaaattatttatctagtttagttattatagcttctgcagcagcttttagcttagatgcggtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccatttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtagcagcattctctatgtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttaccagaagcctttgcaaaagcagcgccagtagcaactagacttttccaggccatactaactgcatttcccgtaaatccttctgctttcatgtcgcgagcaaattggaatcgtgattcgtcagaagcatctttataggaatatttacccgctgcaatggctgcttttgcgacagcttgaatttcggtgctagatgcttcatttaacaccgcttcatttaaaaattgagcatatgatttcatcttatttcctgttttaattcgtggatttaatatactactgtatttatactaaaaagccccaacctttcggtcggggctaagccttgcggcaaccttgtcggggttccacctgctaaggcaagtgtttgtacgaaacgccgggatttgaacccggttattaagcagttgacgctactcaatatttttaaaaggccatatctcgaccatatccgaacgttccgtcaaaaacgctactcggcttacggcaaagatatttcctcgaatcgataattcggtgcgccgtttcagctgtgatagtaaagaaccagaacatagtaaaactgtgggaggaactatactccagggaacatcagtccgacgacttaccggtagcgacccggtttcttaatattcttttaaagcatcaatatgttcacggcatttacgccataaatcaattgcttcatacgcagattcagcatttcgaattggacggcatttatataaagacttgtgattttgatattgcgtagataacggaattttatctaaaaggtctttatgttcaaagtattcataaccatctaagccaaatgaacgatttttaagaaattgccaatgaccgtattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggctgacgtgataggattcgaacctataaccaatcgcttaacaggcgatcgctctgccattgagctacacatccaaattggtggggagtgatggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccatacaaggatttgaaccttggacctcctgatcccaaatcaggcgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctcaagcaagaacccttgatgatagagggtattaatcagtgcggtatgagttaataataacaaataattcttaaagcaaattaaacattttaacggtcggcaaaacaatttcttcttctatataagagtatttaacactctcaactacacgcaagaaatcatagtcataatattcagaagcatgaccaagaatatcaataaggccttcaaatatcttattaccattcacaaagaataagtcaaatacacgttcttcatcttcttcggatttattaccaaggtcaacttctatatcaaagacctttttaatgaattctggataaagttgttctgagaacagtccttcaaccaagtattcataaataaaaagcgattgctcgctgaacaagccattaccacaataacgttcagctttagtactagaatgtctgcttttaaacttctttaaaagatattggaactgtaagatttcatgctcttctacgccaaacagtgttttagttttatagttgtcaccatcattttcccaggtagtgacatcaattacgtagccctgcggaattgtagtacctaaacaaatattcatttttcaccatgctgcgttaatgtaagtatatttaatacattcaagacccaaaggattcttgaaaatatcatattcaagaagacctttttctgtttcaataaagaaatcaaaatttactgtattaaatttacggtcttccttcactaatttaacttgtgaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttatagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcagtaattttgttaaatgctacgaaattaactgattcttttccttcgtcatcaaaaacaaacacacctttaattgggcttttaccattaagatagcaaaatgcttgttccataatcgtgattacttctaatttagtcagatttaaattagtctcacgatcatagtcaattccttcaaactctttacgagttaagcaaggatagtcggtgtttgctgcaaatactccccatgcataagccaatgcatccttaataggaccagcaagttggtatttaactgcagaataattactcatgataaaatcagcagtagtatcttttccactacgctttacaccgcttaaaaagattagtttcatgtgtttctcctcaaatttaattaagattataacacacaaagctgaagcattaaacttctgctataattttaccatctttttctacttgaaaataggtgtaaggaatcgttgctgtacatactaaagccgggtctgaatcttccgtgtagctaaattctacttcagataggtcagaaacccaaggcttataaaaatttattgacatcacgatttcagttttactattatctaaaatgtaaagcgtaatgtattcaggacctgttttttgggcagtattttcgcctgtaagatagttactagttcctagcatccattcatacattcctatccacgacttaagctcttcgtcaactataaatctcacgatgagtggatcgtactcaaatgtaacacctggacgttgtgctcgaccaagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataaatgttggtggtataatgggtctaagtcccttccattcaattccaattagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccggggatatatgccttaatcatttggtctgcacccctaaatcctttcacttgactccaatcaatttttaatttagttttattagtaatagtaggtgtatttgaatattgctttaaaagctcttctagaaattgctgacgagctttaggtggaatatagtgcaagtttaatccgtacattaaattatgtttacctaaaccaaggtaaattattaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcacgcaatgtttgtctgaatgaatttatcataagcagttgtctttcttgcttattgagtttattcattggttttgattcaagcttttgaatcttttcagccgttttaattcctgaagcatattttgacattgccgaagtaaacgtagagtatttgattcctctttcttcagcaaattgctttcctgtcattccttttgctttggcctttctgtattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagattgtgctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccgcagttgtattgggttttattgatgtgtaatgataattatgatccgtattatggatggattacttcgcaagaagctgcttatcaagcatctatacaaaaatacaaaaacgtaggtggagaccaaatagtatatcatgtgaatgagaacggtgaaaaattttataatttaatatcatacgatgataatccatatgtttggtatgacaaaggcgataaagctagaaaatatcctcaatatgaaggagcacttgctgcggtcgatacgtatgaagctgctgttcttgaaaatgaaaaacttcgtcaaataaaaataatagcaaaatcagacatcaattcatttatgaacgaccttatacgtataatggagaaatcttatggaaatgataagtaataaccttaattggtttgttggtgttgttgaagatagaatggacccattaaaattaggtcgtgttcgtgttcgtgtagttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaatggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataagtgtgttactgccggccatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagcggttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgcgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaataccgagttttattttggtgaaggtgagatttctgttaatgcggcagaaggagcattgaccgctaattatattggaggtcttaaacctactcagaactctacgattgttattgaatacatcagtactaacggtgcagatgcgaacggcgcagtcggattttcatatgcagatacattaacaaatataactgtcatcaacattaatgaaaatccaaacgatgacccagattttgttggggcagatggcggcggcgatccagaagatattgaacgtattcgcgaattgggtactattaaacgcgaaacccagcaacgctgcgtaactgcgactgactatgatacattcgtttcagagagatttggttctattattcaagcagttcagacgttcactgattctactaaacctggttatgcatttattgctgctaaacctaaatcaggactatatttaactactgtacagcgcgaagatattaaaaattatctcaaagactataatttagctcctattacgccatcaattatttctcctaattacctttttattaagactaatttaaaagtcacatatgctttaaataagctgcaagaatccgaacagtggctcgaaggtcaaataattgataaaattgatcgttattataccgaagatgtagaaatttttaactcatctttcgctaaatctaagatgttgacatatgtagatgatgcagatcattctatcattggctcatccgcgacaattcaaattgttcgtgaagtacaaaacttctataaaacgcctgaagcaggtattaaatacaataatcaaataaaagaccgttctatggaatctaatacgttttcatttaattctggacgaaaggttgtaaatcctgatactggtttagaagaagatgtattatatgacgttcgcatagtatcaacagaccgaaattctaaaggaattggtaaagttattattggtccatttgcttctggcgatgttacagaaaataaaaacattcgtccatatacaggaaacgattttaacaaattagcaaattctgatggacgcgacaaatactatgttatcggtgaaataaattatccagctgatgtgatttattggaatatcgctaaaattaatttaacatctgaaaaatttgaagttcagaccattgaattatattctgacccaaccgatgatgttatctttactcgcgatggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaagacagactcgggggaaaatctcccgagtaatcaatatagatggattaacttaggatatactgcaaataacagcttcttttttgacgatgctgacccattgacatcatacattattagagtagctacagctgcacaagattttgagcagtctgattggatttataccgaagagtttgaaacttttgctacaaatgcttatacatttcaaaacatgattgaaatgcaattagctaataaattcattcaggaaaaatttactcttaataattctgactatgttaattttaataatgacactataatggctgcattgatgaatgaatcattccaattcagcccatcatatgctgatgtttcatcaataagtaattttattattggtgaaaatgagtatcatgaaatacaaggttctattcagcaagtatgtaaggatattaatcgagtttatttgatggaatcagaagggattctatatctttttgagcgttatcaacctgtagttaaagtatccaatgataaaggtcaaacctggaaagctgtaaagctcttcaatgaccgtgtaggatatcctttatctaagactgtatattaccaatctgcgagcacaacatatgttctaggatacgacaagattttctatggccgcaaatctactgatgttagatggtcagctgatgatgtcagatttagttcgcaggacataacattcgctaaacttggtgatcaacttcatttgggatttgatgttgaaatctttggtacttatgctacattacctgcaaacgtgtatcgtatagctgaagctattacttgcaccgatgattacatttacgttgtcgccagagacaaagttagatacataaaaacgagtaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacac

SEQ ID NO: 24 - DNA, 117957 bp, Artificial Sequence
  Description of Artificial Sequence: Synthetic polynucleotide
  modified_base (4494)..(4494): a, c, t, g, unknown or other
  modified_base (4497)..(4497): a, c, t, g, unknown or other
  modified_base (12685)..(12685): a, c, t, g, unknown or other
  modified_base (61129)..(61129): a, c, t, g, unknown or other
atgtgtttccagaaaatttcttctttaactacatcatctttacgagtatcgccttgtttgcgttggatatgcaaattaaacggaatatcgttttgtaaaagccactcacgtgtcataacataatattttaacttagcattttcggtgccagattcacgtccgcttacagtaataatctcataacccgagtgatgaagcatcttcagatattgtacaaccatttcgtttggtgtatcggttgataatttatctaattcgtatgggccacgagatgtatgaatagctagtgttccatcaaggtcaaagattgcagcttttggtttaccaggagtccctttgtataccggaagaccgagatactctcgcatacttttatacattgagcgtaaaacatcaattggtactgctttagttccacgttttgagttacgtttaaccaattcagtccaaggaacatcaaacactttatattcaactttccatccgtattctttggcaaaagtttcccatgctaggcgacgttcaggattcaagttagtgtctgaaataattactcccttgacagaatcaccgccgtacagaatactcttcgcggtatcaaactgcataccggtcacaatgccttctttctttttggtatacttgtactcgtcacgttcttcatgacccatgatggattgacgataatcatcacgattgatattataaaatccaggatttttagcaataaattcacgagcccaagtgctcttacctgaaccaggacagccaatagttaaaataatctttttcatcatttaattcctaagaaaacttcaagaatacgaatattatgctcacgtcgctctttatacacttcagctgttgattgattcactgatttgctctgaacattagatgaaataaattttatcatgtgatttttaagctgatacatatcaagtccacgagcttttgcttcttttcgtagagctttaccagcgtcatctaaagctttcgtagggtcttcatcatttaatactattccacgatccaaatccatgtatactgcaccatgacatgcatcaatgtaaaggtctgagcattcaatataacgttctaacagagttttcatttatttttctcaactaatgattgaatataatcatgcaggtctttagatgctttaccccacttattttgatattcatttttgagattagcacgggattgagctaataaaacatcattagttggaggtaaagattctaaccgctgaatctggcgtccataaatcattgcagccatctcggattcataaatcaatcctttgagatgttcaaattgatgccatgaaatcatttacatttatcctcttttaactcttgacgataataacatatcatagttttttggtcatgtacatatcgttttacatcattaagccaaatacgaaattcctgggaatcttcaaatgacataccgacccaagctttaccatcaataactttaacttgccaagatagtttagcttcatcatatgactttatctgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcacgccgcaacatcttctgccatatccgatgcgctacgatttggattactaattccaagacgatgttttcccgttaaaggattaacgatgatatagcatttacagttgttaatatgaacattaggttgagtctgattaataaacacttcacaatcatacttagcgagttgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgtaaatccatcataaagtcctcatgttatgtcagtaagtctactataacacaacacgaggggtttgtaaacagcttagtatccttctgggataaattttttataatttttcaaaaaattctgttcgatttcacacatgaccttttcttgactatcgtacccctggtataagctcatgatgataccgaacagatgttccattccagcacctttagcaacgccttgcgcttccattgcataagtctttctatccttaccacaatgtttattgtgacagtcaagaactaaaaacagagctcggtctaagtacttcagataagtcgtttcaaacgcctcaatttttctgtatgaatattcatcatcagcgtacattgctttaagatcatctgatgcaccatcaataatagtcttaaacagtttttctggattgtctaatgagctttttgtactatgaagagacacgtaccagtcagacttaattttaaaatgagaaccatctttcatcacagcaacatagccttcgatgttttccgcatttttagcttcttctacccatttagggctatcgatttcgtatcgttcaactagatatggacgaagaacagcatctttataaatgtcatcatatgaaatgtattcacctgtttcattttcacgaatattcaataaaatgattttcacctcttgataagcaagaacgattctattagttggagcgacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcatctggaagtaaccaatcagaataagatgcataattatatgagaaaattctgtaagttcttccagatgcacttacatcatctgagtaaaaaaacttacgctgtgaatccttacatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaagataagatgacagttctacttcttgcggcgcggattgaacattatcagaattaaggtattcacgaatccaaggatatggatgtttaaccggagcaccggtaattgggcatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgntcncactctttggcaattttaacccattcatcaccatcagtgccaagttgaagttgacgaataatatattgtgtacctttaaggtggagttgctcatcacgcgcaataaatttcataatcttcgcgttaccttccatgatttccatattcttatggaagttgaaagtacatgcaaaagatacataaaaacggatagcttccagggcattgataacgtgcaagcagagataaagcgacttcatcaggtcacgtttacaacctgcaacatggtcaatagcgtcttggacaagttcttcatcatgctctgttgccaggtagaattctacgtcagctttagcgttttcccattcacgagtctttaccagaacatcatcataataacgaccaatcgattcagcacgtttcatgattgcatcatcaagaataatctcatcaaataccttggcagggtcattgaacaggttacgcatgatgtgagtataagaacgtgagtgaatagtttcactgaatgtccaagttgcagtccatgtatctaatgacgggtcagaaatcaatggcatcagtactgctgcaggagcacgtccttgaatactatctaacaatgactgatatttcaggttgttagtaaaaatattttgctgatactgaggaagcttattaaactgtgcagcatccatcatcaagtttacttcttcaggacgccagaaaaatgataattgcttttcggttaaatcttcaaaaactttatgacgttgaatatcataacgtgcaataccaagacctgaaccaaaaaacataggttcttttaaaacatcaactggatttgtattaaaaactgtgctcataaattttccacttagttaatagttggtgactcgtccatgagtcaaattatatcataatttacaggatgaacaatcttcagcttttggagtttctatttcataatcatcagtaccagaaccgtcacgggtattatgataatagaaattttttccgccaaaataccagaaatacaaaaggtcatcaatcattattgacattggaaccttgcctttagggaagatttgggggtcatagtatgtattcgctgaagctgattgacatacccatttcagcataatagctacctgcgtaagataaggtttattacctttcttagctaatttccatgtataatcatataagtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcacaaggtcctttttctttggcgagcttaatggatgctttaatgagtccatactgtaatctctcaaatagttcatgtgttaaatcgttagcatcttcataagaagcaaagttacttgccaaccaagctgcatagttagtaacacctacgccgaggttacgacgctttttagctttttctgcttcaggaactggatatccttggtaatccaaaagattatcaagagcacgaacctggacttctgccaattcattaattttatcttggtcttgccagtcaaaattatccagtacgaatgcagagagagtacacaatccaatttcagcatcaggactattcacatcatttgttggaatagcaatttcacagcacaagttactctgacgaatagatgccttttcacgaataaacggagtatagttattcgtattatcaatgaactgcacataaatccttgctgttcctgaacgttcagtcatgagcaattcaaatagttcacgggctttaatacgctttttacgaatattagggtctttttctgctgcttcgtataattcacggaaacggtcttggtctttaaaataagaataatacagctctccacccatttcatgcggactgaacaaagtaatgtaatcgttctttccgaatcgttccatcatcaaatcattcagctgaacaccataatccatatgacgaatgcggttttcttctacgcctttgttatttttcaaaacgagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcagcacgaatcataccaacgttaataccaattccagcgcgtttagagatatattcaacaattgaagcggaagccttattgatagacttcaatgaatctcctgcctcaataacaacgcatgaactgaactgtcgagtcggagtacggcaaccagccataataggagttggcagtgaaatctgtcgagtagatactgcttcataaaaacgaataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgttcgtgcttaatttttgattctaaaaatgtaatttcttctgctgaatattttgacaataattcggggtcatatttaccttcatttacacagtaagaaatatggtcaataaatgaacgtggttcatattgcccgtaaacatgcttacgaagagcaaacattaaacagcgtgcagctacgtattgataatcaggctcttcaactgaaatagaattcgcagcagccttaatgacaatagtctgaatgtcatcagtggtcattccatcacggagatatgatttaatattttcatataattcataaggatctacagatgttccttcagctgcccaagataaaactttaataattttttgtggatcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaacgacaccagaagtatctttaaatcgtaaaatcatatatcctcgcaattaaattaaaattataccgccatttttcctttcaagacaccgtgggactgataatctttgagaacgaaatctttaggcctgagtttaagaatatattccaattgttctttagtagaaagataacggaatttataaggcaatccgcctattaccagttcacaaagctctttaggttcacgacgtaaaatttctttacattgttctacgtgattcatatagatatgagtattaccgccagaaaatatcaaatctccaggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcgtcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatatatttaagttcagctggattccatgctgaaacaatttgacgcctatcatttggcagttttttaatacgatcaataacttctataatttggtctacaccaccaaaatcacgccactgttttccataaattggaccaagttcaccgctatggtatcctaaatcttttgcttgattttcgtaattttcatcccaaactgttttgccttggattaacgaatcatgttgaattaatcgcaaatcattgacatttgtgcttcccgataaaaaccatattagctcagcaatgcaagctttccaggcgagcttcttagttgttactgcaggaaaacctttagttaaatcccagcgtaatttagtaccgaacaaagcaattgttcctgtgcctgttcggtcatcggttttgtagccattttccaggatatctttaattaaaaattggtattgtttcattagttcatccaagaatatgtagaaggatatttggcaaagttaggcttatatcctaatttaaccatttgttttgctttgcgagtaaatcctaaagaacgctcacctttaagatattgttttggtgtcataggcccttgatgcatctgcctacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttgcgtctaattgaaccgttgaattaacacgatgccttttaacgatgcgagaaacaactacttcatctgcataaggtaacgcagcatataacagagcaggcccgccaattacacttactttagaattctggtcaagcatagtctcgaatggtacattagggcttgacacttgaatttcgccgccagaaatgtaagttatatattgctcccaagtaatatagaaatgtgctaaatcgccgtctttagttacaggataatcacgctcaaggtcacacaccacaatatggctacgaccgggaagtaatgtagataatgactggaacgttttagcacccataatcataattgtaccttcggtacgagctttaaaattctggaggtcctttttaattcgtccccatggtaaaccatcacctaaaccgaatgctaattcattaaagccttcgaccgttttagttggagaataagcgaataccaatttaatcattacgcaaaacccctttcaataaaccattcagtggctttattagcatcaaagaataattcttcatacgtcttttctttgttttcaaaaactgtcacacaaacacgttgacattctccacagtattcttctgacatgctcaaagcgtcagaaaacatttcgttaaattcacttaaatcaggattatgcaatgcgttaaaaattgcataatcgaattcatcattcataaattcaaatacaaaaatcatattacctcccactgaaaggggccagaagcaaatccgctatctttaatcattttaactaaagttaccattcctttgttaactgcttgtgcgatttcatcaaaaacttcatcgctatcatcataaaggtcattaaaaagttctaacacgttcttctgaacttttaatttatgaccaacaatctcgcctacagtaaattcgtttccgccgattccagtgtaaaacgtaattacaccagttaacagactttcgcgagaatctaggtcatgtgataaattaatataagccatcccgggtgcagttttaagttggcaacgaattcttacttgggtaattccggttacatgaatgacggacatattattttcctcaaatagactttttcacaattttccaatcagctttaaactgatcaacgtcagaatgataaatccagaatcctgcgctttctccatcctcataaagagggcatctatcacattcatcttcccatcccatatcacgcaaaagatgttcagctttttcaacaagcccagaatctttaccgatgatattaaaataccatttacctttaacttctgaatctttgatgctctggcgttgtaatctcattttattctccttagcaagctttaatcaaaagatataaacagaccaacataactgctgccataatataaggtgcgaacattttcttttctccattagttttgatagggtaatagtattatcacactactaccctgttgtaaactactttttgaaagtttttcgcaaaagttcaatgatttcatctacattattttcgtcaacaatgcagtgaatttttgttacgccagaaaccttgtctttaacttcatcctcttcagaagtaggttctttatattcgtggaaacaatgaaattcgtcttcacaaacgttaaagtaaaaatgctttccatttgcgcattcaatgtgttttattactctaaatccatcaacaaagaaagcttctttaacttcaaaccatccaccattttcttgaataattttaactattgatgaattagaacgtgggcgataattaataaatgtatcaataagtcttggaacaagctcatactttttgccaatatacattacgttttcctcattttaacggggcttgtaatagccccttgataattattgttcaatcaatcccatgtaaaattctgcgtcttcagaatccataccatcacaatattcattagccataaagcgggtgaggtcttcaagaggaccttcaatgacaatagaaaaattgcaataattgggatcatcgtgaatacttgtgatactaagttcaggataacgattacgaataatttcttcaatatattcaaaatcaacgatgtcaatatcaactttagccatattattttcctctttaattatcagcagtattgccgatagttgtatagtaccatggaaggacaaggatgtaaaccgttttatgaaaaatttttgaaataaaaaaggggacctctagggtccccaattaattagtaatataatctattaaaggtcattcaaaaggtcatccaggtcngtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaatgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttactacaagaatgttagcccagtaagaagttttacgtttaacaagactgtactctttattgtcagtgttgtacagatcatttttactgatatactgacatactggacaagaatcgtaatcaccgtaggtagatgagcatgtttcgatataccatttaccatttttcttgaaaccgtgatttacaagaagtgcgaatggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgcagaagtttaaaaatataacttgactgaacctttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcttggttagcaaccagattgcttataaagattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatatatctttcaccaacagcaggcatgcggagtttaatcatagtagaaaatctaatgtattagttttttcacaacgaacaacagaaggacgtaaaagattttcgtcaatagcttctgactgaattttttcaattatacccgaaggaataaatttagcaaattgagtttcaggaatagaattttcttctaagaatgctgttgtagcttcgagataactcattccaaactcttctaccattttttcaataataaatccattttcttggcggtcaagaagctttgcaatttcatccttttctttcttaattgaaagttctttttctgaaagaccggtctcatcgaccggacgaatatcatttagagaaaactgtgtcataaagttcaactacctcttcagtttcagcttcaaacacatcacggttatctttatgatacaaagctaacagacgattaaacatcttgccatcaacaccaagttcatctttggcacgaattcgaatatctttaatcaattcattataaccagaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccgcgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacaatagaggttttcattgaaggagttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttgtgcatcggtgaccattgcttaacatttgggtatttgtgaagttgagtaaagtcaccatccgacgaaatgattaaaatcttatgtccttctaaagagaactttttaacaagaacagcgatatgatcatctgcttcatacttatcaatatccataacgatgtatggcatataagctttcaattcatctataactttatggctggattcaaaataaccttcccagtcccaagtagattcttctcgtgcttttccgcggtttttcttataataataagcgaaatcacggcgccagtatccagatttcgcgttatcaatacacagcacaattttagtgtatccaagagtttttgcttttttgacattaaacttaattgagttcaatatcaaatgacgaaccattgataaattaattttttctttatctgggaagtttacaagagcagttgaaagcgcaatttgactaaagtcaataaagcaaattccttctttataatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggtgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttggtcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataaccgtttgtggcaaatgtatatttctgattatagcagagaagctgcaattgttactccatcgactgcatatcaagcacaatctaatgattttatcgtacgtagatttacttctgccgcaccgattaatgttaaacttccaagatttgccaatcatggagatatcattaatttcgttgatttagataaattaaatccactttatcatacaattgttacgacatatgatgaaacgacgtcagtgcaagaagttggaactcattccattgaaggccgtacatcgattgacggtttcttgatgtttgatgataatgagaaattgtggagattgtttgacggggatagtaaagcacgtttacgcattataacgactaattcaaacattcgtccaaatgaagaagttatggtatttggtgcgaataatggaacaacccaaacaattgaacttcagcttccgactgatatttctgttggtgatactgttaaaatttccatgaattacatgagaaaaggacaaacagttaaaatcaaagctgccggtgaagataaaattgcttcttcagttcaattgctgcaattcccaaaacgttcagaatatccgcctgaagctgaatgggtaacagttcaagaattagtttttaatggtgaaactaattatgttccagttttacaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtagctgaaattgctacgcagcaggaaactaatacaggtactgatgatactacaatcatcactcctaaaaagcttcaagctcgtcaaggttccgaatcattatctggtattgtaacttttgtatctaccacaggagctactccagcttctagtcgtgaattaaatggtacaaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacgcaaagtgaagttaatacaggaactgattatactcgcgcagtcactcctaaaactttaaatgaccgtaaagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattggataatgttctaataactcctaaaaagcttttaggtactaaatctactgaagcgcaagaaggtgttattaaagttgcaactcagtctgaaactgtgactggaacgtcagcaaatactgctgtatctccaaaaaatttaaaatggattgcgcagagtgaacctacttgggcagcgactactgcgataagaggttttgttaaaacttcgtctggttcaattacattcgttggtaatgatacagctggttcaacacagccattagaatcatatgagaaaaatggttatgcagtatcaccatatgaattaaatcgcgtattagcaaattatttgccattaaaagcaaaagccgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactacatcgggtgatcagactggtggatttaatggattacgtccattgtccattaataatcaatctgggcaggtcacaattggtgaaagcttgatcattgctaaaggtgctactataaattcaggtggtttaactgttaactcgagaattcgttctcagggcactaaaacatctgatttatacacccgcgctccaacatctgatactgtaggattctggtcaatcgatattaatgattcagccacttataaccagttcccggggtattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcgggaccatatgttaaatttcaggataatcccgttggaaatcaaacatttagcgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatatgaaagtgtcgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgcccaagcaggtcaaggcggcatgagaaatttaagcttttctgaagtatcaagaaatggcggcatttcaaaacctgccgaatttggcgtcaacggtattcgcgttaattatgtctgcgaatcggcttcacctccagatataatggtacttcctacacaagcctcttctaaaactggcaaagtgtttgggcaagaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaaccacaggcagctgataacgatttcgtttctaaagctaatggtggtacttacaccggtccaattactattaattacggggtaaatagttatcttcaattaagtaataatgaaacccccattcgaattcgttctggtggcggtaccggtaatactcttgtagttggcggctcttccggcggtattagttttagacctgcaggtagtgaaatcactactggacaaattactattacaccagaaggtttgacaacatttaccagggctgtaacggctccatcgataactgttacatctactccttccgcagcatctgatgttactcgtaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctattaatttaaaagataaaacaattttcacaaaagatgactcaggcaatgttatagaattaggtttaaaatatggaggaactataaatggatctttagaggttacagaaaatataactggaactttaattggaaattctagtacagctactaaattgcaaacacctaggaaaattaatggtatatcttttgatggatcaaaggacattacactaactccatctgatataaatgtaaatagtacaacatttataaaaaataacggcgaattacccgttgatgctaatttagatacatacgggcccattgaagaatatcttggtgtttggtcgaaatctacttcaacaaatgcgcaaccagcaaataaattcccagaagaaaatgccgtaggtgtactagaagtatttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggagaaacagttcaagagcaatcgcatcatttgatcgccattatccagaagaaggatcagccgcacaaggatttttagaaatatttgaaggtggtttatacacaagaacgcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcctgggttatataatattttaggcactgatgccgttattaactgtcctaccggtgaaggtttgccgactgttattgttggtttgctggaagttaaacaacgtgcttctggcggtgctattttccaaaaatttactactgccggaacgggtgcaactactcgcgatcgtatttttgagcgtgcatatactggtggtgtgtggggtacatggaacgaagtatatacatcttactctttgccaattactttgggtatgggtggtattaaagcccaattagcggagctagattggcaaacatttgattttgttcctggtagtatgtttagcgttcctttgaacaaaataaagaacatgccagcaaatatgaattggggtacaattgacggaaacttagttatgttttctgtcggtcctagcgaacacaccagcacaggacgtactgttcaggtttggcgtggtactgtatccaagacaaactaccgttattttgtcgttcgtgtgttcggtaattctggaaatagaacttgcacagttcgccgtgttgttcttgaagacggatcacatacttggactgctcaacaagattttaatggtgctgttaactttggtagttcaacaacgtttaaatcaactacaacatttaatacagaagttaaatttcgctcattgaatgcattccgtatgtatggcggaaaatttggtacatttttacgtaatgatggagagagtctttatattctttccaccgacgaagatgatcaagatggaaactttaatacaaatagacctttccgttatgaattaagaactggtgatgttactttgggtggtgctagtggtgctaacgttttaaaattaaaacgtgattctctcaccgcattttttggcggtgatattaacattaaaggcacgatgacttttgacgccggacgtttaggatcacgagattattttaaatttaaccattggggtgatagtaataatgcgcgtgataatatcatccagttagaagacagcaaaggcgctcatttttccactgaacgtactttagcgactggtgcaattaagactaaattttttggtgaaattgaatccgatggtaaattggttattaaacgtccgggtgattctattgtattatcaacaactgctagtaattctttgcatattcgcggtgatatagacgggactggtaactggtatattggtaaaggtggtgctgataatggattagcgttctatagttatgctactaatgctggtgtatacattacaaacggaggggatatcgcgctaagtccaaagggtgccgaaatggctcaggtcaataacgttcgattatatgttcatggtgaacgttggactgctagtcaaccaggtgattggggtcgtcagtggcaagtggaagcgccaatattcgtcgatcatggttatgttggaccagatagctattatccaattattaaaggaagaagtgtaatcaccaatcaagggtttgtaactgccgtcgatcttggtattcgtcgtgtcaataacaattggggacaagcaattattcgtgttggatctgcggaggcatcgccagcggctggacaccctaacgcgatatttgaatttcattacgacggtactttctattctcctggtaatggtaactttaacgatgtgtatattcgttccgatggtcgacttaagatcaataaagaagagttagaaaacggagcacttgaaaaagtatgccgactgaaagtttatacatacgataaggttaagtctattaaagatcgtagtgttattaaacgtgaagttggtattattgctcaggatcttgaaaaagaattatcagaagctgtatctaaagttgaagttgatggatctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagaaaattatggcagtagttggtgttcccggttggattggaagttcatccgtaaatgaaacaggacaacgatggatgagtcaagcagctggtcaattaagattgggtgttccttgctggatgagccaattcgccggacgctcaagagagattattcatactgtaagtgctaatcataattttaatggtcagtggttccgtgatagatgctttgaagctggcggtgcacccattgtattcaatattgttggtgatatcgtttcttattctaaagatgttcctttattcttcatgtacggggatacgcctaatgaatatgttgttcttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggtggttatgactatggtaacgcacactccggcgctggtggtaatgctggtgctgctggtcagaatgcatggtctgacggcggtaaagttcttaaagttggtgttggtggtgcgtctggtcatgcagtgtttggatcttctccaacttggggtgttgttggaacaatttacggaccaagagtataatgtgaataaatacccttaaaaggagggtctatggcagcacctagaatatcattttcgccctctgatattctgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacgataaccatgtattggtatagaaatgatcatataagtaatgaccgccttgaatcaatatgtgctcaggcggccagaatattaggaagggctaaataattatttgttcgtatacatttctagatatcgatatacaccctcaaaaccctcgttgaattcatcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctatgaattccttgaacgactcgcgttcctgagctacattatgctcgattaccttttcaagattatgactcattcgaaataatcttcaatttcgtaatcatggacataaatcattatagtttctaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatccttatgaacagaagctttattaaaattatgctttgcgactaaattgttcatagtgctgaattacctctcttaaacatttgcatgtgaatgaaaactttttagctacaccacattcaaatatatgttctcttaaatcgcgtgtatcggtatatcccatctcaacaataaaatgccgtattagatttttatctttatcgttgagagaattaaaataatcggattttgaattaatttccctggccaatttgaatcaccttcagttggcgttttagctcttttatcatctcttcgttcatcgcaatataaagatcgcgtaaagcaagttttagcattccatttactggataactaaatggacatacataatcttttcctacgagctttttggtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaagataaatttcgtaagctgaatccataaaggaacttatagctgccatgaaattattgcgaatacctactggagcatctttactttcacgaataatcatgtatttgccagtcttaatctttacaatagttccaagataagccccatggtaccagatgtcccacccctcctgagtgggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactacgataagtttcaacctttttaagaacaaatccattttcatctaaaagttttaacatgaagtctttatcttcttccatatcagaagtaatctcgcgagctttacgagttgctcgttttttcagcagttcaggagcattttcctgtgcatataaagttgccgcatttgaaataatatcctgagcttcaccagtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttctaatctccgtaattctgtatcagtagttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagtttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatgacgttcttcttcattatcgctcaaagaatattctttgcggaatttaactttgaatccaaaaccatgctcaccgcaagcatcatcccatgtaatgaagcctttatcttcaagtgggtctaagattttactcacgtaagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgtaatacagctttcttaacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatatacgttatagaaatttttacttacacgagcaaaaatataacgacttgctgctgctttttggacggtacgagaaccaaagtttccttgaccatctaacagaggaaaattattattccaagtgttagccatcaaagcacctgcgtcttgcgcagagttttcaccatgatgatatccaaggtccgctacaccacctgcaatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctactaataaagcagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttgtttttaagattgttacgatagaactgcatcacatgttcgttatggaaattactcatacacaccacacattttgcataaacgttcaaaacagataaatccgccacctacacacatcacgacagccacattatcattaagaggtagacctaaagccgtaaagattccagtcaatgtgaataaggctaaaactaataggtaacccattacaaatagagctttcattagtatgcctgcaaaacaaatttaaagttatcagccaacatacggttcatttcttcaagtgtttgatactcagaatgatgattacgagtaaacgctaaagctaactgaccttttccaaatcctgtcgtcaaaggtttcatcttagaagcaggaagataaaatactgcatatggaacattgttatttgcaatagtacgcgcaagctgagaccgacgttgacgaatatgacttagaactgcgctgaatccttgcttagaacgttgattacctacataaaatcgtgcagacacacatggattactaaatggacgaccatctaatttacttactaaaaagtaaaatccaggtttagataaaatatctttatgcggagttcccaaaaaccactcaccacccttgattgtaccaataacagtagcacctgcatcattcagatcagtaacagtcatatatttcatattaatttcctctaaattattttctactccaaggccgcatgaatacgcggccattaaattaatcgtcgcagtcgacgctcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagttgatagggtaatagtaccacggaagaacagtcttgtaaacaactttttaaaaatattcgtaataaatgtgaataccaatcaccactgctgaaacctgtgcaacccaccacgcacaagcaataagtacagaattcaaaattttcataataacctcatcacaaaagtaaatgttaaacaaattaatggaatactaattaaccaaacgaaacaccaccataatgaactcatagttcaatctcagcaattttcatttcattactattaatagccgctttaagactatctgaaagaattacattccagtggtcattcatatgaccattaactaagcgtgtaatttcttcgggagttgaaaaataaggcgtatcagactcccaatgcgataatcctaagcgagtataaatcataccttcatcatcgctagaatattcaactgacacaaactcatcagttattttatgtttagcgtaataaaatttaaatttcattttccgctcctccgtagttgatagttgtatattaccacggtccttgtggtatgtaaaccgttttgtgaaaatttttaaatggaaagataccatccgttgtagttgctttttcttacaaccttacgaaggtcttctctgtcaccgatgaacttcggagtgtactggatgacacctgggtgaatttctttagtgttgaatataattatacagtcagcgacctgatgattcagaatgggccctagatttattccagaaccatatggatactctccgctgcatcctgttgttacagaaatccaacgtgagtcagtttgatgtgtcttaacttctacacgaagcccgcagtatcttggatgcgccaatacatcccatgcgtatgtatacgggtcattaacgtcctcttggcctttgttaacatacccgcttagccaatctgctacaaaaaactctgcgtacaccgcgatacggcatctttcgataacttctgccttatcctgatttgggttttgttttaaagagtatcttgctgtatcagcaattttgaccttcatttcactagtcaaatcactgttcgatagggtaaatgtcggaatctgaaatagtctctgtaaacccggattcgttttctgcatttagactttcctttttaccgctgagataagcgttatatactttaagagtgccgtaataaattcggtcattttcatctaaagactcacggtcaagttcatcgagttcctttttatccatgactataacatcattgcaataaagaaacccaagttttttgtgtccaaactcaaatttattacagtacacaatattagcgtgatgattaccatgtagagaaatttcttttatgtcggaatcaccgatattcatacaataaatcataattcaccttaaaacaaaagggccgaagcccttattttatttgaattgtgcaattcttttctctaaacagtcagcataagatttcattgagataaactgcgaaagtaacagttcttgctcaactgcactaactgttagaaactttgcgctttctaaaaatttgctcagtgcattaattttgagcattaattgatcgtattcttcttttactcgtgcttgataacctaacataattttccttagttaagggccgaagcccttatttaaattgttcagtaacgtcttcaactacttcgtattgacaggtacgcattttagcatcgttgtaatcaatcggaattgatactacatcacgcggatgtactttaacttttacaactcggctggttgaactgccaaagtgacgaatataagatttagaacacacatgcagaccgcgagaacaagtttgtgtatcatcgtcattcacacgagtacgtggcattttaactactttaccaggactgttatcaaaagtatttgaatgacagtcaaagtagttgtcacgaactactttccaagcatagaagtaaccatcttcggtgatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccagcttatccgctacaagcagattgagaatttcctggaagtttgaatgagtattaggtgttgcgttataagttacaccgtcaacagtaattgaaatgaattttttagatgcattccaaataatgtcagatttagcaactggagcaataactgcatcgctattaactttaactgtaatatcaccgctaatagtaactttagagcgtttagcttcttcagcatttttcaaaacacgacgaattgtgtcaaccgatacaccttgccaatcagccaattcctgttgggtgtaattaccacttgaatacaatttaacaatttcagcttgttcgtttttggtcaggcatttaatattgtacataattttccttattaggccgcaagggccttcatagttttagcgatttgggaaacttcatcatcatttaaagagttgcgataaccgatgaagtcggaaacaatacggaatttcttggtaaactcagcaaccattttatcactattttttgaagcattacgtgataattcatcaaagagattagttactgtccagatatcatgaccgatggtatcttttccaccattgaaatacacaccgcgtaatgaactaaccatattaccaagtcgtgtatattcttcagaaacttcgtctgtactgaagtacttcatcataaaatctagttcaggatacttgataattttatcaatatatcgttgagctgaacttgaataacctacatacttatcataatctacatcatcaaaagcatctacatataaatcacgcagagtttcaaaaatacattggcactgaccgagttcttttacctttttctgcaaaagcggacgaataacataaaattcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgctcattgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatgactttgcttaatgcgtttcagtcgagggtcaagatttacttcatacaccacgcctgcattgcataacttactatcaggttcaaacatactctgcatcttcttatatgacagatttttagtcgtgaatttgactgaattactaatcatataatctcgagcagaataccccatcttcattaattcgcgatatgtatgacgaggagatgtagattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccgttaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcagtcataatagcaatattatgataattcaagttttcagctttttcaccgagaactaatccagtgattgcgcaaatatcaaacaattctttgtttttaagcatatcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcattagaattgcttcattatttagaatagcacgtgaaatctttttagcatcaagttgaatatgactacggatttcgccaaatggagaagtcaaacgctctttagtttgagaatcaaatcgcatgtttttcatatcacggacaaacataacgatagtcaaacattctttaacgcgtgctttagtcacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagagcaattttcttgttcttgaacaatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacggatagtcgaatccttgaagaatagaccagaacacacggttccttctactttctgcccagtaggtccaatagcacgaaatccagtatgttggaaatcattttcagagcaaccgaaccagttgtatccagtgatttcaatattagtaaaaccacttgaagataaaactttggttgcattatcagcatcagtacatcctgctaaagacactgctaatactaatgctgcgatagaacgattaatatatttcatagttttcacttaaatttaatggcttgaaggagactaataattctcaagcgacttctttcatctttaaccgtaaatgaaagagggtcaccagatttcatagtgatagtgcattcaaaatcaaaaccttcggggacttcttcgaataggtcaaattcttcatcatatattagaacattactctgaaaactgtgaagaatttttccatcatttccagatgctgtactaatcattgtaacattattacctttcatatcttcaacgataaattcgcttgtagatattacggcattaatagaaccattcctataaatagcagaaaatagatatttcttttcttcaccttcgcgaatgcgatatttcttaccaattttaaacataattaccctttaagtaagtcgtaaaaaccaccattcacatgcttaggagcggaaactaaccgaatagcaatccgatgacaatcaggacatacatcagtatccctttcagaaattttcttgattttttcgtattcttttgcacagtctttggattgacatttataatcataaagcggcataattattccttaaagtgtgctttcaacatctgatacaaggaccatgcttgttcattattttcaatagtaacgttcataaccgggaattcagatggatcagttattgttgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgccgaggaagtggttgtccaccttcgataaattcaaactcataaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttagaagataattcttcccgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacatgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcagaatatctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccatcgatggtgcttacatcttcatctgatggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttccttgctaaatcgcgaatttgacctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataaccgccttataaagatggctaatttcacctaaaatgtaatcactgattgtaacagtttttacttcaccacaaaagaattctaacgcaatcaaatctcgttcaatttcttccaattgaagcattaacttgcctgattcaattttcacgtttttgcgatttttactataagctatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatagcctcacacataaaacacatcataacgaccacgggtaacaccaacataaagaagttgttgggccaattcagcatctgcataatgaatacaaggcgtataaatgaaagcacggtctacagacataccctgagctttatggaatgttgatgcaggaagtgctttcactttactaaactgtgatttagcatcccaaaaatcactccatggagcttttccgcctttgttccaatttttataagtttctgctgttttacctaaaaatagattaaacttatataactcttcatcagatgaaattattttaatcttttcacgataatattcatcatcgccgtaagtttctactgttaaatcccaatgacgaattagatattccccaggaacaccacgagctttaacaaacgttgatgtatactcagcttctataatacgaactaattgtccgttattaaaaataatttctgatacaggctttccatcaattttatatgttttaattaatggttcctgcattacaataatttcaccaacaataaaatctttatcagtttcaaaaatctttttacgaataatgctatttaacttatcaacagatttattcgtaaatgccattacgcgattttcaaacaaatcatctagtgatttgacgattgaaaaataatttaccataaaatcgcgtaaagcggtatcaccggtaaatccacgtactccatgcccgtcaacaactttatcataaatccacttaccgttacgaacatcagtagctacatcaataataggagcattactgcgtttaacttcagtaagttcacactgataaaaatctttgtgtgtaaagaatggactgatataagcagtattttctcctgggtcaacaggtctaatttgcttattatcacctattccaattatggtacaccatggcgggatagttgaaagcagaattttaaatagctttctatcatacattgacacttcgtcgcagattaatactctgcatttagctaaatccggtacttctttttgttcaaaaagaacgttttcttcatatgttactgggttaattttaagaatgctatgaatagtacttgcttctttccctgatagttttgaaagaatctttttagccgcatgagtaggagctgctaaaataataccagtttcacccgtagatattaaagcttcaatgatgaacttagtaagagtagtcttaccggtaccggcaggtccattaatagttacatggtgtttcttttctttaatagccttcataacaatgttaaaggcatttttctggccttcggtcaaatcatcaaatgtcatcgtaaattccctgcaattggtatactaacaatacgcccagtatctaaaattcgctgatataatctttgtgtgtctacgtcgggcttaacatgtttaacttctattttattaaaccaaaacttgcgtggagtctcaactaatcttggaattcccttacctaaagctaatcgatactgctctttaagagtggtaaatactttatcagcaatcttccattcaaaaaatacagcaggacgatgttcatcaagtggaactggcgcaataaatccatctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataatccttagcttaatgtcagaggtttgttttgatttagaaagctgtgaaatgtgttcaattcggttttcacgttttttctgtatagctttaatttgattataggtctttttgattttagcccatttcttttcatctaaatttagtttatgaacttttttcgcagatgaacgaccaattcgcaaagcaaataaatcacgcttttcaatcaactcctctaaagtataatcagaacgaaatgtattatactttttctttactgcaataacattccctttaatgtatccaatgttattatcaaaacgttctaatgataatttctctccttcaatacgattatcaaaaggttctcctgagtaagcgcaaactttctgatctaaaatgttcttaatgtaattgaagtctaagttaaaatctttagaacgtcttttagcagatgcctgagtgtgctctaaacgacgtttaattttacgaatttgattattagacagtttcatatttttctcacatcttacggacgatttaatacttactataacatttttacttcagattgtaaacaactttatgcaaaaatgctttaaaaatttcatggtataatgaatctaagtccttccattatagattaaatccttcaaagtcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgtagagcttttatagcatactcctggaaattgaataccataggagctttgaattcaaaaataacctgtgtgttatactctaaaccggaagcaaaatgtatagctatatttttatcatatgaagctgatacgactttatcaaatgtaataatatcaattccttgatttaacgcttgcttagtctcgactggaacacctctccaaagaggtttatcgtttggaaccaaacgagatttgactatttcatttaaccaagaatgatcgtctggtttattagtaatacaatgaattaaaagttcaatttcagataaattaaatccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattttatactttccaattggaatcatccattcttgttcacgtacaatcatcattaagttatcagtacgttctgaatctaatccatcagtatcttcatatgtatacttaaattcagtattaggagaagaaagtataatatcgctgatatggtcagaataattaaaagctttatcagtttttaagcgaaatattatttcagtgaaatactcaacataagaaaaaccacatgctgtgcgcaaactagtagtaaatgaatctactctgttcgttgaaaacacttctccaacttgtaaatctttaatgagttcttttgtcgattttgatataccacgatatagctgataaggcgatttagttaaatgctttttaactattttattcaactgccgatgaagagcttcattctttttggcttccatacactgccaaagaactgactgttcaaagtcagtaaatttttcacagacctttttgtacatatcatattgaaaatcgacactttcagcttttatagataactgttcaacatctgcgagattaataatcatgatagcctccatatacttcagaagctatcatatcattgttaggaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaataacgattagcttcaataatctttctttcttcttcagatattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcaacactaatcattgatttcatccattcttccgattcgttctgcatttctttatttgcttgttcaacccaaccatcatcaatatacatcgagtttggtctattgaaccattcaagcatcttcttcagagctttcatttgttttacctaaaacaatagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataactcttatcaatcattactgctacggtaattggaacgtctttagcaaacgacatactaatactattgatagacatttcaaacaaaatcgcttccataattttcctcaatcacaagatgtagatgaacaactagaatcacaagaactttcacatgaatcgcccgtccatacatgaacaggaacattagtatcatatgaatcagaactagactgtgtattctgtgcattagatgatgtagtaggtactgaccagcgccaaggatttttataatattcttgggcttcttcataagtcatagtaactgcttctactgttccatctcccatataaacatactcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattaattttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctctttcttctttttaggaatctgttcaggacctttatttactacagcgcctgacgttgttccagtagagatattttcaggattaccacctgaatctccagctaccatatcttctttaataaattctttatatgttttcatattaacctctattcataaaagcattaaaaatttggtcatcaatagatggcacagtaatattttctgcatcatttagcaaatcattaatttcatcagatagcataacacatgtgcctttatttcctgtaattgttactgcacaattacgaacgttttctttatcaaattttaggttaatattttcgtagtgaaaatcctttaatgccgaatatatctttaaaatgaaattgtcttttactacaataaacccaacctcactattaaaacgtggttcatggaaactgtaataaaccttttcatctataaaatcgtatgaaattttttccatttttaaatatgaaaattcagaactatacatattaacctttattcataaaagcattaaaaatttgatcgtcaatagaaacatttactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaatattccaccgacatactctgtgctgcgtttaaagtttacacgtttcctaaatgaaaaatattcaggttctttatgagcccgactcataggacacaatgagtagctagaataagagatgtcaaatcctacaccttcaatatgagccaacgcgtcatgattaaaccaattataatcatatgccaaatccattatattgtaatatgtgaaaggcaccggattaacatcatgtgttgtacctttaaaatctgcccaggcaacgatttcgttatctttaacaattacaaaaattgtgtcaataagatatccacggttattttcatcaggcgttatattataacattgcgcatcaggaaatttaccgtatttaaacggtggatttttgtgcatataataaatcatattattcacctgtgatttcggttacgatatttttgttattaaagtttttatcgcaatacagaacataattatactgcattacaccaccagacttaagttgtttttgcactttagctttcatttcgggacgatcgcgctcaacaatattcataatatccgcttcaatttgagtttcaacttcagtctgatctgcagtcatagaccattcacacaagtctttatcatatcctgccatagcaggctgagcagcacaagaagccaaagtaaaaattgtagcaaaaataaattttttcatgataatctcctcagtagtttatgtttatatagtatctcaatttccaacaaaagtaaacagctattttaaaacttctgcataatcacatgttacaaactgtttctctagcttaacgattttacgaaaataccttttatactgacgaatctgcctcttcgtaggacgtacagcaaacttaataaattccactcgaccaaatggaggactttcttctgctggaatatctaacaccaattcccacgtatccgcaataagtgctttgaattgcgtatttttcctgacgttatacggagtaggtttaaataaaacaatatgcatattatcctcggtaatctacttcacatactttcttgtcatcaatgaaagctttaactagtgctttattaacttcagcatattgagtagtagcccattgaacgtcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgtaattcctctgcaatggctttaacagttgtgtaactattttctgagtaaactctaatgcggcaagatttacaaatacccagatagtcgacaataatgattgttggaacaaaattcttcttgagctttaattcgtttaaaagcgatcgaaatgtattagcatctgctccaccagtaggatactgtttaacgattaaacgaccgagagtagatttctcacgccatttttccatttttcctttatactcagcgtaagaaatatgcccatcatcaatgtcatcaagagaaacatcaagcatattagcatcaatacgtttagcgcagacttcttctgccatttccatggaaatgtaaagaacattatgtccgagctgtaaataatctgctgccaatgaacacagacctaatgacttaccaacgttaacgccagccattaaaacgttcagcgttccagtttcagctccgcctttagtaattttgtttagaattctgagtttaaatggaaccttacgagctttattcatataagatagccaacgtgcttcgtagtcatccatccaatcatgaccaacgtaactatcaaatgaaattgataatgcttggcgcatgatgtcaggaatagcaccaacatccggcattttcttatttcgtttttccggaggaagctcagcattagtttgaatttcaattattttagatgtggcgttaaacatcgccctttgctgaacatatttttctgtttcttttactaaccagctgtggtcttccggagaatcagccagttttgaaataagtgtttttacaccagaatattctgtttcagtaaatgaactattttctaatgcaacatttaacgcattaatagatggaacgctatgatactcgttgacatgagatttaattaatttgaatgtatttttagctggaccactttcaaaatattctgaatccatatatggccaaacttttgaaaaataagcttgatcaaatataagatgagaaagaataatttctaccacacttactccttaaaagaatttaaactttttctttgaccttttattaaatgcatcttgtagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcggatttaattatcttaagagattcattaaaaagacgttcttttctttcttcttccccctccgaagagggggattcatcgataatttctagatctaaatctaaatcatctttattcattaaattcttccatatcacttaactgctcgaggtcagtttctaaatcagcagctgatttacttttactttctggagatttaaatttttcaacctttgagttaatcaattcatcgacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcaccggtttcttcgtcaagaaattcacgagcataccagccatttttaggttttaccacaaatcctaattcaagagccatatctaacaatccagaataaggatcgatgccaccgtcaaatttaacatcaataaagaatttacttttttctttaacggtacgagatttttctacatttagaacaaattgatacccctgaagatcagaaccatctttaatctggcgcttaccgataatgaatacagtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttccgtttctttcttagaagccatattaccgattgagtcgatgaatacaataaccttttcaccacgctcaatagcttcaagctggttcaccatatcaattttcagttgttcaactgactgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaattgcaccagaaatagcaatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttgcgcgaaacacacatgcgaagaacctttaatggctcgtcttcttcacccaacgattttcgtttttcaatattagaagttttccaacgagcttgctctggaaactctctattgatttgctcaagagctctattatgttttgaattactacgaattgaactgcacccgcccggagcctgtgcttttccagatacaaccagatatttgaacaaggccaaatgcggataaccttgattaattaaattgagaaatgcatacatatcttcgcataaatcaatttttccatacccaatttgttctgttgtaagttttccaaggtcataccaagtattcgtgaatccatatgaattttcacgataattaccccaagatgaagtaattttaaaaataggtagacgagcatggccatgataataaccgcaatccatggcatctttaacgtattgaatcaattcatagaactgttcacgagttaattgattaattttatctacacagcgacgatcatctttctttcgcattgaactcatacgaatagtagtatcatcatcaatcatccaaattcgttgacctgcatacatatcagtaattgctttacgagtaccagcaattccgttaacatcatcaggaatagttataattttagctctagacccgtaagcgtcataataagctttttcttcgtgttcacgtactacaatatgcggttcataatcagatggaaacatatcaagggcagaaactgcccctacgcgttgatagcttggaattacgaattgaatcatttccactcaccgttataatcttttttcgcaatatgtgtttcaccagttttccaccaatggtcaaccaaataaaaatgacgggaatacacatgaaggctcccgacattccatataatggaacctgctttatactgacgagttgaatcacctgcattcaaatcagatactaatttatctaatacgtatttttgccatgcataatcattacggaatccgaagaccacgtcatttgaacgcatgcttactactgcattgactttcttatcacgaatcaggtactgtactgtattcgtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaaccccaacctaaaataatagttggaatcataagaggaaccgttacactatagtatatacttattataatcatcaagattaaaagcaacactgctataattttgcttttcattccttctctctgatgataattacctgatttggttgtgcagactttttagtttcacccgcaattgaccaaataaatgtaataaaccaaccaataattgaccagttaaacagtaaagacgtgaaaaagattcctactgttgattttgacccacgcatcaaggcgatgaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccagtacgccattggtaattattagcccaattagcccaaatttcggcgcagtagttttcaattttttcttcgcgtgtaattacatcagaattacgatatgcttgagcagattcatctggacgaatagcttcgtcaaaatttgcctgcatttgttctactgtttgctttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagatttaatcacaggttgagtatcattttcaacactaacaaatggaactgctactaatgcaactaaacaaactgctaagcatcccataacaattttcattttattctccaaatctgtatcagtagttgatagttgtatagtaccacagaggaacagtcttgtaaacagttttgtgaaaattttttagggaattctaaaggtccaaaatcatctgtttttcataagtatagatttatattacttgtatgaaaaagggacccggaggtccctagatttattctatcagccaaacaggaagtctaacgaagctttttcttcatagtccataccagccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacgggcatttaaatcctggccaacctttatcatcatatttcgctatatcgttcgcagtttttacttcagcaataactttatagtcaagttgacgatattctttctcgaagttcttgtaatattcttggacagactcttcaccttcttgaagaatacgacgaatactttcttcgagagcttcttgtactgcttttggtgttgaactctgctgagtttccatacccatgatttttagatgtggttcagcaaatcgcttatcttccatatcataaacgttcagagcataacgttttttcgctttccaaaatccaccaacaccctttgaaccaagcggaggacaagaaatagcttcacggtccatatgcatcagatgctcgcgattattcatataatcacataactcacgatatgcaacatcaatcataggttccatctttttcttaccgaactgattcatgaattcaactaaatcattttgttctttaaagcggtcaagacctactttttcaataactttatctacacaaacatataccgaatcagtatcacctgctgcgatgaaatcttcaccattagttccacatactttattnagatattcattaattttacgagcaatccactgaataccaacttggccgaaaattgtgatagcagtagcatttcgcaaatcatagtaacgaaaatgaatattaccaagagcaccgtaaagactgttaataagaattttacggttcagctgatttgtgttagcaagtgtagctgctttttcacattcttcaatcaaactattgagaacagattcggtgtaattcgatagttcatttaagaaatcatcactgaacttaacatatcgttcaacttcaggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgcccacgaatagtctcaggactaatgttaacctgacgaataatgctcggatacagagacgtcaagtcaaaactcataatatatcgacgagcaattggtttaggttcaaacacaaatgcacccggaaaactctgtttaacgtgcgaaccctgttgaggaataaccttatgttcacctttcaatgagttaaaaataatggcatcccaggttttaataggactcattacaccagaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgctgagcaactgattccaaagagaatgacggcaaattagtaaatgcgaatttcttatacaaatctaaataatcaagaatagatacgccatcaatagaataaatttctttgctaccgtacatattttggataagtttagattttactcgaccgattggagagaagcgtttcatactacgttcaccgagaaccattttaacgcgattcatgatatacggaacgtcaaatccctcaatattccaaccagtaaaaatagcaggtcgtttctgttcccaaagattaatatattccatgagcatatcacgctcattatcaaatggcatataaattactcggtcaagaatttcttgaggaacttcatcaccaccttcacagtcaagcttagcagctaactttgcatcccattttgatactgaaccatacattgaattcaaaaggtcgaaaacataaaaacgatcgtcaattgaatcataatgagtgatagcatcaatttcatattctgctttcattgggtcaggaaatttatcaccagtaacctcaatgtcacagttagctacacgaacaaattttcggtcataaacaatttctgaaccatatgtatcactgatataagcgagtttaaaatcgttcataccgagagcttcgagaccgatgtcttccattctcttcatccaatctcgagcatctttcattgatggaaatttttgaggagcgcagtttttaccatagatgtctttgtactttgactcttccttacaatgcctaaacatagttggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaaataaggggccgaagccccttgcttaattaccaatcgtatatttaggaacgagtttccattcatgtttttgtttaaaagaaataactcggaagttattagttaaatctttcataaaagttctttgaccagggacgatttcaatcagtccccaatcttctaacagccatgcaatcgaatcacgacgaacttcatcttcttctgtcatttcaacttgacggccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataccgcttagcaagtaacttaataatcaatacttcggtggaatcttcaactagttttgcccatttaccatatcttttaccccgaggaactgcagccattagataattaaaatgagcttcatcacttaatccagaaccgattaaattcatagcatatacagctggcatgcactctggaaattttgataatgcattttcaaccatgaattttgaataatctttttgagcaatagagcatttagttttattattaatagctccaattatttcaaaaaactcattttcagctttttctttaaaagaatcagcagcggattggacagctgtccaatcttttgaataccaagcaacttgatgctcgtttaattgaatatcatcttcaaataagctcatatcacttccactgcatttcacatgctaactgaatgaaaagataagctaaatgcaattcagtattagctgcaataccatgatactgattattttcgccgacaatttcgtacatacgaataatactctgtggagttacacgtgaatagatttcttcggcaagtttaccaacaaaccaagaataatcggctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttgcagatttcagttaatcgacgaatcatctgcttcatcatttcaattttatcttcatcagttggttgaccgaatgtaataactcgacagcgtgactgaagcggtttaataataccatcaatattgttagcagtaataataatactacagtttgagctataagcttccataaaggaacgaagatgtcgctgagactctgctaaccctgagcggtcaaattcatcaataacgattactttttgacgaccatcaaatgaagcggcgctggcaaaattagtcaaaggaccacgaacgaaatcaattttacaatctgatccattcacaaacatcatatcagcatttacatcatgacacaatgcttttgctacagttgttttacctgttcctggagaaggagaatgaagaataatatgtggaatcttacctttacttgtaatagatttaaaggtttttttatcaaaggcgggaagaatacattcatcgatagtagatggacgatatttctgttcaagaatgtgttctttttcatttacggtaatcataatttcctcattcaagttttagtgtaaatttaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgtgcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcacgagtcataataaattgaccggatttaagcataataccggagttaatagtagcgaaatttttcagcagagcagtagtatctttagacagtttcatgtaatttccttcaattcaaatgagatttaattttataactaatttaataaagcaattaacgattaaaatcagccgcaattgtttcagcaacaatttgagcagcaacaattaggcgttcatctgcattaccgcaatattcatcttcaaggcgttcaccacatgaagtcataataaatttagcaccggcgtttagggattctgcagtatgtttgcgcattagttcaatccatttattacttacttcacgatcgatagcttcataatacgcatgacgagcaggtgcagatttaattttgttctgaataacttccattgcgttatcagaaagagacaaaacccatgcgcgacgaattttattttggttttgtggatttgattcagaacgcacgtgttttggctgaatatcttttacatcaacagtataattcacggtaattttagtcataatacacctttagtcataataatcagtaacagtccaagcttcatttctgttggacattattttcgtatattctgatttaaatgcattcttaagcatagattcagtaactatatgctcttcattagaaaaattatttctcagaatatatcgttttatttcaggaatagttaatagatgctgtccagttgaatattctgccacagttcctccgtataaatatgtttatcactcgctgtatcaaaaggatatgttatgaattataaactaatttatgaaaagttaatctctaatgctaaatctcgaaaacttgattgctatactgaatctcatcacattataccgcgctgtttaaatggaagtgatgatgcttcaaacttagtagatttaacaccagaagagcactatgtagctcatcaacttttagtaaaaatttatccttctgaaccaaaattagtctatgctgctaacatgatgacagtttctacgaaatacgctaaacgcaacaataaaactttcggttggattcgtcgtaaactctgggaaatagaaaagaacaaagaattctcccaggagacacgaaagaaaatgtctgatgcagtagctaataaagcaagactaacttgtcctcattgcggtaagtctggattaagcgggaatatgaatcgttggcattttgataactgcccaaatcaccctaatcctaaagttagaccaccaatgtctaaagaacacagaaataatatctcaaacgggcttaaagcaatcgttcttgaagaaacatcctgcgaattctgcggaatgataggcaagaaatgcgttatcgcagcgcatagaaatttctgcaagaaaaatccaaatggacgcaagaaaactgaaaagactggtacttgcgtccattgcggtaaagttaccactttcggaaatttatcaaggtggcataatgataactgtaaatataaacctagctaatcttagctaaactaaatctaccaactttttccatctgaatatgctgaccatattcttgtgggtcatggtctttatgcgaaattatgaagaagttggtatccttcaaaccatctaaaattttagctacatttttaatgccttcagcatcaaatgcaccatcatacacttcatcaagaaataaacaacttattttaacacctgaaactttttcagcaatatcacgccaagtaaataaaagagcaatatcaattcgtgctttttcaccttgactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcaatgctatttcatcagcatggtcaataaactcagaagatgctttttctatagctgctttaacttttttagctttatctactgtcgtgattagagattgctttttattgcgaatatcatttgccaacgactgctgggttttaatattatctcggtattcatcaacaagaacttttaaattatcacgatgtgttgaaagctgttcaaacgaatgcgtacattcagaaactttatctttaattttagaaacaactttatcaccggaacttaattgtgacaaacaggttggacataatccgccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgaagacgagtaaggttgtcacccgttaattttttctggcgttcaacgttatcattatatattttaatttgttggataatactatcttttttaacatcaagcacttggttctgcgaatttaattcacgtattagtgctttattaagcttatccatttcagctaatgttcctacctcaagcaggtcttccacaagctttcttcgtgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccattaatggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccgaatgtgatggcttctaacatagtagacttaccaccgccatttcgtccagtaataagagttttttgaaccttatctaattgaatgtcaataggatttccacctactgacattatattttgatatctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatatttgctatgaattcatcattaatgtcaaatgtcgaaaacttcacagtatgcatccttaatacaagatacagccatatctcgtaatgatttaggtgtgtcattatctaaaatgttgaagttaaaagatacagcccaatcagtgcagaccgtgacctttttaatacaattatcttcaacctctagcggttcaaaccaatattcaataatttctttatgcccaatatcatcttttacttcacattcaaaatgctgactcatcataacatttttaaattcatcaaaagtcattgtgttgcctctacatatagctgattcgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcaccggcagttagtgtccatggtgtcccaatatatctgacattagcagcctcagaaatagtatggaagtgaccagaccacacttctttataagtcttaaggaaatcaggttcaagaccgtgagatttcattcctttataaaaataaaatccattcagttcccagtgaccaacacaaaaagaagcagaagaagtttttatgtgctcgagaatttcaccagtattttcttcacacatccaaggaatcaaatcaatcaaacacccgtcaaaatctactgtagtaggcttatcatatactttaacattaggatatttagccaaaagctcagtagaggcatttggatgcattacatttttgtagtggagatcgtgatttcctacaatagtatgtagggtaataccagcatcatcaagcatttgaactatttcacgagcaaactccatagttttatgcgtgatcgcttttcgcacatcaaaaatatcaccgtattgaatccataccgtaattccatttttcttagaatattctatcgcttgcttaattccatcaatttgaataccgcgaatccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcgcggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccattcttaataaaccaatcacgttgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataggaatcaacccacactttcatattagggtctgctcttacaataggaggattaacttctttaattgaactatcatggtattctttttcagaaattttcacgcaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgttttagaatatcccgacttttcttgatagcatattcgtattgagcaaaattattgttttcagctgcagtctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacggctgtcatagacattgtgaacgaaataactatatttctttgcaacttccttacgttcttttttaatacgttggacgaatgcattaaaacaagcttgagttatatatgcatgtgggtttttatatttcgtttcatcaaaattatgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacaatatgcttggaatactttctccatcatctttttaaattcatgaatatctatataatgactagttaaatcagcatgatataaaaagtctaaaaacttttcatgtgtgctaacgtattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattgatcaacatattcaatcaattcgccgtaattggcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcgcccttccagccttcgtacatcattgcgactgacaatgacaaggctccttcgcatgctgcatacttattattccagaaccaatttagaaaaacttcgtcctcaataccattgtgtttcatgttctggaaaaatttggcgcgttcttcacgaagcttttgcgataacatagattcaggattcatttaaattttccaattaccgttttcatcaatgaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaagtattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggtaattcatatgttaataataccacagtttgagctcgttgtaaacaactttgtgaaaattattttagggaatgataagaagggaacgatagcttagaatggtaatatacagaatgtaagaaagaaaggcccagagggcccgccttagtcttctatgatatctctatcatatccaagtgaaatgagagtttctttgaagtgtttaatgttcttttgtctagaatcattgatgaaaatgactggataacgaatgttaagagatgtgaatccagcgcgtttagcaagagatacaatcagtggacgatcatactcaatcttaccattatttgtaagaactttatagaaagtaaaaggagcattaagctcctttagaagttttgtaactgattgacatccaggacaacgacctacttcatctggaattccatagacttcaatcttattctttaagttcgagttttgttccacgagaaataattccttgataagcccagtatggcgggttaacagaatcatcgccagaattttcttcaggaaaataaacctggataacaaatccagatgcatcaaaggtaaaataaaccgtaggtaattcacctaacaattcagcgcggttattaatttcttcaagttctcgttctcgtccagcccaaaaactaggatttagactacattcatagaaataatagtcattaccgaacatatcaaaacccttccaactctctaccacatatcgctcaaaactaatcataattaggcctttttatcaagaacagcattcagtttgttagtaattttatccagacgctcattgaactcgctagaagataagcctttttctggagaaattaagctaatcacgaaaaatatagcaataaaaggaataagaaaaatagcaccaactgccataaacaaaaagaacgttacagttgtaagaaaatcagctaaacctttacgaaatttatacatattttacccttaattctaagaccaggcattgataagcactaaactatattgcgaataaaattctggaccaaaatgaaaaatcatatcatttatagtatccataatgtaattcaatttacgccagaatgcgttcgcacagccgccagccggtcactccgttgatggttactcggaacagcagggagccgtcggggttgatcaggcgctcgtcgataattttgttgccgttccacagggtccctgttacagtgatctttttgccgtcgaacacggcgatgccttcatacggccgtccgaaatagtcgatcatgttcggcgtaaccccgtcgattaccagtgtgccatagtgcaggatcaccttaaagtgatgatcatccacagggtacaccaccttaaaaattttttcgatctggcccatttggtcgccgctcagaccttcatacgggatgatgacatggatgtcgatcttcagcccattttcaccgctcaggacaatcctttggatcggagttacggacaccccgagattctgaaacaaactggacacacctccctgttcaaggacttggtccaggttgtagccggctgtctgtcgccagtccccaacgaaatcttcgagtgtgaagaccattgtatatctcctctttaatcatgtttccacactccgtcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttcaccagtgaatggaacaccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaatagccacatgttcttcttattgtgttcatctttttaggatcagtttctccacaaatagaacaaacaaatccgttttcagtaggagtcatttcatgggtacttccacatgtaaaacatttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaatccggttctttcagtccactgcttaagatgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcactcaagaaactgcggcaacccattggagaaacaggaatagatgagccggtgatagctttattgttcttagctgaaataatatcaggatacatccttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattcgcaaaagtcgttccgccgtattggtgagaagcaacttgcgcagtaatttgtgccataattgcagtagcaactccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttagtgtcagattcattatattcaaatcctctttgaagcatctcagccatcatttcctcttttcctaaacgagaaaattcctttgatttatctccaacaaagttagggtgaatattattttgggtgtaatcggattttaaataagtaagtaaattttctaaccattcaagataatcaacaccttgcccctttaagccagaacgattaaatttatgtttcatttgaccttctgcggcattgcagagattacaaagcaatccacgtacctttcctgcttttggtccatttaattcatggtcatgatcaagatgattagcttgaacatcaggatttagttctcgttggcaaattaagcatttaccgttttgtgcatcataaaatttctgtttttcttctttgtataatttgccagtcaataacataataaacccttaccttaaatagataagggtatttattattttcaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgccccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataacctttgctgtcatcaaagttccatacccataataaactgcaacttcatcacctacatataccgcgcttccgcggtaatcatgaatatagtcatttccttcgagcatcatttaaaatattctcgcagttggtcaaatccaccaatatgacttccatcaggagcaaatacctggggcattgttaagccgatttgagtatcacgacctagtttagtcagaagctcagcgattttctcatcatcaaaaacacctttttccggcataatgttgataaattcaaacggctgtttcttcacagtcaaaagacgttttgcattatcacaatacacacatttgtggatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcagtcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatacatttccactacgtccataatttttaacatcatgcggagtttataagacaacgaacgaatagttttgttgtgcttattaatttctttagctgtaatggcgccaagattacgtgagtaataataaggaacctggatattaattaatactgatgaaccacctggcttgtgtgttacttcatcagcaataacccagtccttaacatgaactgtatttgtacggtcatcgcctgcagtaaacagcttgcgagcatgcttaaaaagcatattcacttggtcattgaattgacaagcaaatttatcagcaaatttagtttcaggaatggtagataaccaatcagccaaatgggtctttttaacatcgttaacaatagtaaattcaaccaaatcagttatagatgtcgcagatttaatgaagctcggcttcataaagtttttaatgttatcacgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataaggctgtcaaaataatcaatataatgtttacgagttttcatgttcttctcacttggttaatgatttatactccgagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaattatatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgatattttgaccaaacatcggtatagctttatcatcaataacgctattgaatgatttgatatattcgttacgagtcataataatctcctcagtagaaagtaagaacattataccacatccttgtggcaaagtaaactagttcagtgcatttagtgcattgttcagtttagaacgttgcttcgtgagatttttgactttttcttgtgctttttctagcatcttttcagcttctaacacttcattggtcgctttaacgagttcatcatctactgccttaagggacttctcaatcgcatccgcgtgccatttttcaacaggtttaagactcggattttcaataggaagaaaattcactttattgaatttccatgcatctttattacctgaactatacatccaaaatttaggatcatttgacgagtaattagataaatttaagttatcttgcacttcctgctttttctcttgcgggacttcgtcctttctcaaaaaatcgtatttaaatgaaacgatcatatcaagttcatatgatgttgtatctaacttaaatcgttcaaaacgaggtaaaatcttagattgaacagcagcaacaacatccatatacttaaatgcttctgtcaactgtgatttaagacattcacaaattgaaagagaatttttagtattaggcttaaagctgattcgcgcagttcgattattttctttagatggtcttacttccatttgaagagtataaccatcaaatttcagattctttaagttaatatcagaaccttttaatcgactagccgtagacaaaatttgctttaattgtttacggaataaagcaataaatctccattcaagacgataatgatttggattataaaatcccgttgatagatcaactttactttgaccaacgccttgaacaagtagaggatttttataatcaacggttttacagaaatccatgagctgttcacgggcagtcatttgcgtaatatatccagctttatcaaaatgccgcaaccattcagcgctattcaatgagttaaagtgaatattacgtgtaactttatcagggtctaaattattttcacataaaaatgttatgacattacgagtataactagcattacgaaccatatcttcaatttgagaacgagttttcatagtattccttaaaatttaagtaaatcgataattttaattaaattttcacgctcagatttagctttactgcttaatccagacaatctaaaaatttcatcgtcatattgttgaatagaaatatttagctcttcaatttgcttattaaaataatcaatttgttcagaatgtttttcgttactacgaactggtacaggttttgtaggaaatttagttaaactggattcatccgggcgataaattaaaatgcaatttgaaccaatcgggcatttagcaccagatgaatattctaacgttccagcttcttttaaaacttcaaaagctaaacagagatgatgccccatattaacataatctgtagagcgagctctgatataataatcatcgccgcgaatactaaatttaaagcatttaaggtcttctgtattattggtcttaaaaatcatttgtttatctagacctttagctaatcgagcgcctaatgctaataatcgtcgttgattttcccacaaatctgcgatcatttggtcaaatgataatttcggcattaatcgaccataaaggtcatatcctttattataattgcgaaggatttcactcgcattaatacgagacaacgctccaattttattaagggctttcatgatgcgattagataaacccattccagacccgtttgttcgttgtaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcattcaattttttattaactaaagatttaattactgcattgacattattaattactactgacatatttcctcactcaatttcaattttactaaatacgcagaatatgatggaaaagactatataagcaccgcatacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttataagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgataaactcaatatcttcttgagttacacgagataatttagatgctttatcctttttgtactgttcgttagtatcacgagaccagtgtaatgtacgatttttattcgtatttttgtaaatttctacaataccgatctcatcgataataacgatccaattccaacgggatttgtaaatttgtcctccatcaacagtgatttcacctccgattgagatgtcattaaagaacttgctttgcgcttcagatttaaatttaccatcgttgtaatttactaagttgaaaatatctttagcgttcattttctgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatattcccaatcatttgtccatcgcatcgttgttgcgaattgaagtacagcttctttaattttagtttcgtaaatttcacgagcctttgagtataacatcattacctccatttaccagtttaattctagtcatctttttgatggcagtccatataatctatttctgaactgcctttttgtcatagaagtcctcttatgaattatttcagaagagtaacctcagcgatttcttcccaaccgtttttgtcggtcataataaagtcagcaagataaagagcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaactgagcgggacactaatgcttgtaaatgtggagcaagtttagtaccacggtctaattcgcggtcaatatcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaaagggagcccgaaggctccctatcatttataataacttcggtggttttcaagatagaccttctcaaggaagtcatcccagaaactcatgtctactttttgctgcataccgttcttagaagcttcagtagatgatgcttctacttgatcgaccacatcttccaaaaactcttgaactgttttaaatggatgcttacccaacttcacgtcgagaataaatggagcatcttggagtggataaatcaagtcgccagttttgtaaatttccaatagttggagtccaccacgacaagcatgactcaaagctttccagtcaataccttcattggcttcggccttacgagcacgttcaccatattcagcatctaatttgttcagtgactgcttaagctcaataagagaaagcgttgtctgatatttacgacccaacacagtgtagaacgtttgtgggcctgttttctcatgattatggaacacccattcacagaattcgttttctggaagacgatgcttaatatcttcaactttagtgcgacgctgcttaatagaaccatcttcttggtaatcaatccactgctcagggatttgattaactactttcaatacatcacgtaatgcagccaaacgagaacctttgacaccgtatttagaagcttgcttgcggacatatcctaaatatgatttcatgttagtcgtataaaaacgagaacggttgtcttgaataaacttccacacatcaggcaaatcagatttaaccactagttcaggtggagtgtgaagcatatccaatgctacagtttcaccatctgctgctaatttaaagaaatatttaagactgtatagttcatggtcaatatcatctttagtgtttttagatgatgtgttgttagtgtttttactcatgtgctctttaacatttccaataagaatatcacgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgatgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaataagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatgaataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataaccttgccaacttgtaaaccattaaatgacgttttcaataaaattctgaagctttgtgtgagcatcaaccatgattttcatttcttcctttgcgaaagctgtacctctttccctagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccatcgtatgagtatccttcacaatgctcaactgctaattgatatgaatctatttcaacatcacgtgctaatttaataatttttcaaactgttcacgtgttagcatacttaaactctcgtattatgatcgataatttcatcaagaaacatatctaaagcttctacagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatggttgtatagtatcacagctcaaattgaaagtaaactggtaaaatgaaaaaagtctcccgaaggagactaatgttattcgagggaaagaagatatttgctctggtaaaacatcccagtaatatcatctatcgtgctttgaatggctggaggcatttctttataaatgctgttagattggtctagtatgtgatcaatcattctaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcacgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcgtattcacataagctattaattcgttttctttcttatcaaaccgatcagcaaattcttcttgctgatcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatattgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcaattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaagtattccactttttagcatatcgttttaacaatgtatcatttttatatctgcttgatttatctctttctccgtctttatatgcatatattaatttctgcgcaaattcagcttggcatgctttatttttcccacaataatccgcggcagtacggtttacataatctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagaggatatcgcctttcttatatcgcccttatgtatatttaaccaataagaaagttcaatgtacgcccaggaagctgaattggaccgtttattcaacattctttttatttcagcatcggtcatattataaccaagttccttaactcttgctcgcatagtaggcaaataattttggaacattccataggcatgatgctttggtttagattttaaattaactccggcagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaactttgcgttaggtttacaaactgtaaatccaagccaaagatttccatctgtgatttctaaacgtccaggacgatattcaaccccctcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacgctgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattagaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccaatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcgctcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacaggtactaataaaagcggaactaccaatggaagaattagtgttgctccaaatattgcaccagattcaatatcagtcataacgtctataaccattccagcaatcaccagaatcacaaatgatacaactaccacaggacctattaacacatcagtagaaattagctgacgctttggttcatacttcacaggtttacttggaaggtatagtgatggctttgacatattctttacattccttaacaaatttttctaataataaatcgctttcaaaattgggattttctacgaatttatcaaaaagatcatcaacaatagttaagatattctttttactaagaatacgcttattttcatattttgtttcagagtcaactataaaagtaaagaaatatttctttccctgaaattttaccgtagtatcaatataaaataaatttgatttttgtaaattacgtttaaaccatgcatcacttaaactataaacgccaagataatcataatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatacgtttaagagcatttagtaattgatctggaacatcaacctgtctttggaactcttcaaacattgaattgaaatcactttgcattttcattcctatttactccaagtaataggggccgaagccccttatcattatttcagagaattaatatattcctggacatcggcagaggtagtttcaaccccagaaatattgccgttaaaagtttcaactcgagcaagggtatcttcaatatcaaccttagtcagtgctgcaatttcaactacatcatcggcagtactaattccaagggcatttgccgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcatcaagttacaggctcataatatctcaatcatgagcctatgtaaacttatttcatattattaaaatattcttctgcgatttcgtcgttatcgtggtaaactttagaagacagtttaacataaccttcagcagtgaacatattaatcacaacctttacagtataccactgtccgtcttcattacccattactgcgtaagtttcaaacatcggatggtcaggaccgataactttaatatcattcactgtacgaccaaaatcttctgaaacgcatttcataaagaagttgaacagttcgccgtaattatccatttcattctccaagttgtttttctgtatcagtagttgatagttgtatagtaccatggaagaacagggatgtaaaccattttgtgaaaaaaatttttaaaagttttagggaattctagggagggatgggcaattaaaggataggataatatattataaagggtataaactaaatgatgcctagagaggtccagaaaggcctagataccaaaaagccctatcatttagatagggatttaaaattatttatctagtttagttattatagcttctgcagcagcttttagcttagatgcggtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccatttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtagcagcattctctatgtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttaccagaagcctttgcaaaagcagcgccagtagcaactagacttttccaggccatactaactgcatttcccgtaaatccttctgctttcatgtcgcgagcaaattggaatcgtgattcgtcagaagcatctttataggaatatttacccgctgcaatggctgcttttgcgacagcttgaatttcggtgctagatgcttcatttaacaccgcttcatttaaaaattgagcatatgatttcatcttatttcctgttttaattcgtggatttaatatactactgtatttatactaaaaagccccaacctttcggtcggggctaagccttgcggcaaccttgtcggggttccacctgctaaggcaagtgtttgtacgaaacgccgggatttgaacccggttattaagcagttgacgctactcaatatttttaaaaggccatatctcgaccatatccgaacgttccgtcaaaaacgctactcggcttacggcaaagatatttcctcgaatcgataattcggtgcgccgtttcagctgtgatagtaaagaaccagaacatagtaaaactgtgggaggaactatactccagggaacatcagtccgacgacttaccggtagcgacccggtttcttaatattcttttaaagcatcaatatgttcacggcatttacgccataaatcaattgcttcatacgcagattcagcatttcgaattggacggcatttatataaagacttgtgattttgatattgcgtagataacggaattttatctaaaaggtctttatgttcaaagtattcataaccatctaagccaaatgaacgatttttaagaaattgccaatgaccgtattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggctgacgtgataggattcgaacctataaccaatcgcttaacaggcgatcgctctgccattgagctacacatccaaattggtggggagtgatggagtcgaaccacccgagtcgcaatgacaatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccatacaaggatttgaaccttggacctcctgatcccaaatcaggcgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctcaagcaagaacccttgatgatagagggtattaatcagtgcggtatgagttaataataacaaataattcttaaagcaaattaaacattttaacggtcggcaaaacaatttcttcttctatataagagtatttaacactctcaactacacgcaagaaatcatagtcataatattcagaagcatgaccaagaatatcaataaggccttcaaatatcttattaccattcacaaagaataagtcaaatacacgttcttcatcttcttcggatttattaccaaggtcaacttctatatcaaagacctttttaatgaattctggataaagttgttctgagaacagtccttcaaccaagtattcataaataaaaagcgattgctcgctgaacaagccattaccacaataacgttcagctttagtactagaatgtctgcttttaaacttctttaaaagatattggaactgtaagatttcatgctcttctacgccaaacagtgttttagttttatagttgtcaccatcattttcccaggtagtgacatcaattacgtagccctgcggaattgtagtacctaaacaaatattcatttttcaccatgctgcgttaatgtaagtatatttaatacattcaagacccaaaggattcttgaaaatatcatattcaagaagacctttttctgtttcaataaagaaatcaaaatttactgtattaaatttacggtcttccttcactaatttaacttgtgaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttatagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcagtaattttgttaaatgctacgaaattaactgattcttttccttcgtcatcaaaaacaaacacacctttaattgggcttttaccattaagatagcaaaatgcttgttccataatcgtgattacttctaatttagtcagatttaaattagtctcacgatcatagtcaattccttcaaactctttacgagttaagcaaggatagtcggtgtttgctgcaaatactccccatgcataagccaatgcatccttaataggaccagcaagttggtatttaactgcagaataattactcatgataaaatcagcagtagtatcttttccactacgctttacaccgcttaaaaagattagtttcatgtgtttctcctcaaatttaattaagattataacacacaaagctgaagcattaaacttctgctataattttaccatctttttctacttgaaaataggtgtaaggaatcgttgctgtacatactaaagccgggtctgaatcttccgtgtagctaaattctacttcagataggtcagaaacccaaggcttataaaaatttattgacatcacgatttcagttttactattatctaaaatgtaaagcgtaatgtattcaggacctgttttttgggcagtattttcgcctgtaagatagttactagttcctagcatccattcatacattcctatccacgacttaagctcttcgtcaactataaatctcacgatgagtggatcgtactcaaatgtaacacctggacgttgtgctcgaccaagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataaatgttggtggtataatgggtctaagtcccttccattcaattccaattagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccggggatatatgccttaatcatttggtctgcacccctaaatcctttcacttgactccaatcaatttttaatttagttttattagtaatagtaggtgtatttgaatattgctttaaaagctcttctagaaattgctgacgagctttaggtggaatatagtgcaagtttaatccgtacattaaattatgtttacctaaaccaaggtaaattattaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcacgcaatgtttgtctgaatgaatttatcataagcagttgtctttcttgcttattgagtttattcattggttttgattcaagcttttgaatcttttcagccgttttaattcctgaagcatattttgacattgccgaagtaaacgtagagtatttgattcctctttcttcagcaaattgctttcctgtcattccttttgctttggcctttctgtattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagattgtgctgctttccatttgtcggtattaacagaatatgtataaatttcattcataaatcttttcttcgctgcggttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccgcagttgtattgggttttattgatgtgtaatgataattatgatccgtattatggatggattacttcgcaagaagctgcttatcaagcatctatacaaaaatacaaaaacgtaggtggagaccaaatagtatatcatgtgaatgagaacggtgaaaaattttataatttaatatcatacgatgataatccatatgtttggtatgacaaaggcgataaagctagaaaatatcctcaatatgaaggagcacttgctgcggtcgatacgtatgaagctgctgttcttgaaaatgaaaaacttcgtcaaataaaaataatagcaaaatcagacatcaattcatttatgaacgaccttatacgtataatggagaaatcttatggaaatgataagtaataaccttaattggtttgttggtgttgttgaagatagaatggacccattaaaattaggtcgtgttcgtgttcgtgtagttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaatggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataagtgtgttactgccggccatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagcggttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgcgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaataccgagttttattttggtgaaggtgagatttctgttaatgcggcagaaggagcattgaccgctaattatattggaggtcttaaacctactcagaactctacgattgttattgaatacatcagtactaacggtgcagatgcgaacggcgcagtcggattttcatatgcagatacattaacaaatataactgtcatcaacattaatgaaaatccaaacgatgacccagattttgttggggcagatggcggcggcgatccagaagatattgaacgtattcgcgaattgggtactattaaacgcgaaacccagcaacgctgcgtaactgcgactgactatgatacattcgtttcagagagatttggttctattattcaagcagttcagacgttcactgattctactaaacctggttatgcatttattgctgctaaacctaaatcaggactatatttaactactgtacagcgcgaagatattaaaaattatctcaaagactataatttagctcctattacgccatcaattatttctcctaattacctttttattaagactaatttaaaagtcacatatgctttaaataagctgcaagaatccgaacagtggctcgaaggtcaaataattgataaaattgatcgttattataccgaagatgtagaaatttttaactcatctttcgctaaatctaagatgttgacatatgtagatgatgcagatcattctatcattggctcatccgcgacaattcaaattgttcgtgaagtacaaaacttctataaaacgcctgaagcaggtattaaatacaataatcaaataaaagaccgttctatggaatctaatacgttttcatttaattctggacgaaaggttgtaaatcctgatactggtttagaagaagatgtattatatgacgttcgcatagtatcaacagaccgaaattctaaaggaattggtaaagttattattggtccatttgcttctggcgatgttacagaaaataaaaacattcgtccatatacaggaaacgattttaacaaattagcaaattctgatggacgcgacaaatactatgttatcggtgaaataaattatccagctgatgtgatttattggaatatcgctaaaattaatttaacatctgaaaaatttgaagttcagaccattgaattatattctgacccaaccgatgatgttatctttactcgcgatggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaagacagactcgggggaaaatctcccgagtaatcaatatagatggattaacttaggatatactgcaaataacagcttcttttttgacgatgctgacccattgacatcatacattattagagtagctacagctgcacaagattttgagcagtctgattggatttataccgaagagtttgaaacttttgctacaaatgcttatacatttcaaaacatgattgaaatgcaattagctaataaattcattcaggaaaaatttactcttaataattctgactatgttaattttaataatgacactataatggctgcattgatgaatgaatcattccaattcagcccatcatatgctgatgtttcatcaataagtaattttattattggtgaaaatgagtatcatgaaatacaaggttctattcagcaagtatgtaaggatattaatcgagtttatttgatggaatcagaagggattctatatctttttgagcgttatcaacctgtagttaaagtatccaatgataaaggtcaaacctggaaagctgtaaagctcttcaatgaccgtgtaggatatcctttatctaagactgtatattaccaatctgcgagcacaacatatgttctaggatacgacaagattttctatggccgcaaatctactgatgttagatggtcagctgatgatgtcagatttagttcgcaggacataacattcgctaaacttggtgatcaacttcatttgggatttgatgttgaaatctttggtacttatgctacattacctgcaaacgtgtatcgtatagctgaagctattacttgcaccgatgattacatttacgttgtcgccagagacaaagttagatacataaaaacgagtaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacac

SEQ ID NO: 25 - DNA, 22 bp, Artificial Sequence
  Description of Artificial Sequence: Synthetic primer
caggttcatcatgccgtttgtg

SEQ ID NO: 26 - DNA, 21 bp, Artificial Sequence
  Description of Artificial Sequence: Synthetic primer
tatttgcccatggacgcacac

SEQ ID NO: 27 - protein, 5 aa, Artificial Sequence
  Description of Artificial Sequence: Synthetic peptide
ERILA

SEQ ID NO: 28 - DNA, 34 bp, Artificial Sequence
  Description of Artificial Sequence: Synthetic oligonucleotide
  modified_base (13)..(13): a, c, t, g, unknown or other
aagaccattgtanatctcctctttaatcatgttt

SEQ ID NO: 29 - protein, 4 aa, Artificial Sequence
  Description of Artificial Sequence: Synthetic peptide
ALIR

The invention claimed is:

1. A recombinant K2 bacteriophage nucleic acid sequence, wherein a heterologous nucleic acid sequence is inserted into the nucleic acid sequence between (a) position 25,443 and 25,444 of SEQ ID NO: 1 or (b) position 75,922 and 75,923 of SEQ ID NO: 1 wherein the heterologous nucleic acid sequence comprises an open reading frame that encodes a reporter protein, wherein the reporter protein is a bioluminescent protein, a fluorescent protein, a chemiluminescent protein, or any combination thereof.

2. The recombinant K2 bacteriophage nucleic acid sequence of claim 1, wherein the open reading frame of the heterologous nucleic acid sequence is operably linked to an expression control sequence that is capable of directing expression of the reporter protein.

3. The recombinant K2 bacteriophage nucleic acid sequence of claim 2, wherein the expression control sequence is an inducible promoter or a constitutive promoter.

4. The recombinant K2 bacteriophage nucleic acid sequence of claim 1, wherein the fluorescent protein is selected from the group consisting of TagBFP, Azurite, EBFP2, mKalamal, Sirius, Sapphire, T-Sapphire, ECFP, Cerulean, SCFP3A, mTurquoise, monomeric Midoriishi-Cyan, TagCFP, mTFP1, EGFP, Emerald, Superfolder GFP, Monomeric Azami Green, TagGFP2, mUKG, mWasabi, EYFP, Citrine, Venus, SYFP2, TagYFP, Monomeric Kusabira-Orange, mKOK, mKO2, mOrange, mOrange2, mRaspberry, mCherry, dsRed, mStrawberry, mTangerine, tdTomato, TagRFP, TagRFP-T, mApple, mRuby, mPlum, HcRed-Tandem, mKate2, mNeptune, NirFP, TagRFP657, IFP1.4, iRFP, mKeima Red, LSS-mKate1, LSS-mKate2, PA-GFP, PAmCherry1, PATagRFP, Kaede (green), Kaede (red), KikGR1 (green), KikGR1 (red), PS-CFP2, PS-CFP2, mEos2 (green), mEos2 (red), PSmOrange, and Dronpa.

5. The recombinant K2 bacteriophage nucleic acid sequence of claim 1, wherein the chemiluminescent protein is β-galactosidase, horseradish peroxidase (HRP), or alkaline phosphatase.

6. The recombinant K2 bacteriophage nucleic acid sequence of claim 1, wherein the bioluminescent protein is Aequorin, firefly luciferase, *Renilla* luciferase, red luciferase, luxAB, or nanoluciferase.

7. The recombinant K2 bacteriophage nucleic acid sequence of claim 6, wherein the bioluminescent protein is nanoluciferase.

8. A recombinant K2 bacteriophage comprising the recombinant K2 bacteriophage nucleic acid sequence of claim 1.

9. A recombinant K2 bacteriophage comprising a nucleic acid sequence selected from the group consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 23 and SEQ ID NO: 24.

10. The recombinant K2 bacteriophage of claim 8, wherein the bacteriophage specifically infects *E. coli* strains that express K2 capsule genes.

11. A bacterial host cell comprising the recombinant K2 bacteriophage of claim 8.

12. A vector comprising the recombinant K2 bacteriophage nucleic acid sequence of claim 1.

13. A bacterial host cell comprising the vector of claim 12.

14. The bacterial host cell of claim 13, wherein the host cell expresses K2 capsule genes.

15. The bacterial host cell of claim 13, wherein the host cell is a natural or non-natural host for K2 bacteriophage.

16. A kit comprising one or more coded/labeled vials that contain the recombinant K2 bacteriophage of claim 8, instructions for use, and optionally at least one antibiotic.

17. A method for identifying at least one bacterial strain or species that expresses K2 capsule genes in a test sample obtained from a subject comprising
(a) infecting the test sample comprising bacterial cells with the recombinant K2 bacteriophage of claim 8; and
(b) detecting the expression of the reporter protein of the recombinant K2 bacteriophage, wherein detection of the reporter protein indicates the presence of at least one bacterial strain or species that expresses K2 capsule genes in the test sample.

18. The method of claim 17, wherein the expression of the reporter protein is measured in about 5, 10, 15, 20, 25, 30, 35, 40, 45, 50, 55, 60, 65, 70, 75, 80, 85, 90, or 120 minutes after infecting the test sample comprising bacterial cells with the recombinant K2 bacteriophage.

19. A method for determining the antibiotic susceptibility of a bacterial strain or species in a test sample obtained from a subject comprising
(a) infecting a plurality of test samples comprising bacterial cells with the recombinant K2 bacteriophage of claim 8 and an antibiotic, wherein the plurality of test samples is derived from the subject;
(b) detecting the expression of the reporter protein of the recombinant K2 bacteriophage in the plurality of test samples; and
(c) determining that the antibiotic is effective in inhibiting the bacterial strain or species in a test sample when the reporter protein expression levels of the recombinant K2 phage infected bacterial cells in the test sample are reduced relative to that observed in an untreated control sample comprising bacterial cells, wherein the untreated control sample is derived from the subject and is infected with the recombinant K2 phage.

20. The method of claim 19, wherein the antibiotic is selected from the group consisting of rifampicin, tetracycline, ampicillin, penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

21. The method of claim 19, wherein the bacterial strain or species in the test sample expresses K2 capsule genes.

22. The method of claim 19, wherein the expression of the reporter protein is measured in about 5, 10, 15, 20, 25, 30, 35, 40, 45, 50, 55, 60, 65, 70, 75, 80, 85, 90, or 120 minutes after infecting the plurality of test samples comprising bacterial cells with the recombinant K2 bacteriophage.

23. The method of claim 17, wherein the test sample is blood, sputum, mucus, lavage, saliva, or a swab obtained from the subject.

24. The method of claim 23, wherein the subject is human.

25. A method for making a recombinant K2 bacteriophage in a bacterial host cell comprising
   (a) contacting a first K2 bacteriophage genome with a first sgRNA-CRISPR enzyme complex and a second sgRNA-CRISPR enzyme complex in vivo under conditions where
      (i) the first sgRNA-CRISPR enzyme complex cleaves a first protospacer sequence

```
                                        (SEQ ID NO: 9)
         5' CCATAGTCATAACCACCACC 3'
``` within the first K2 bacteriophage genome; and
      (ii) the second sgRNA-CRISPR enzyme complex cleaves a second protospacer sequence

```
                                       (SEQ ID NO: 10)
         5' ACACCAAACAGAATATCAGA 3'
``` within the first K2 bacteriophage genome
to produce a cleaved first K2 bacteriophage genome; and
   (b) recombining in vivo the cleaved first K2 bacteriophage genome with a heterologous nucleic acid sequence in the presence of a recombination system under conditions to produce the recombinant K2 bacteriophage genome, wherein the bacterial host cell is infected with the first K2 bacteriophage genome, and wherein the heterologous nucleic acid sequence comprises an open reading frame that encodes a bioluminescent protein, a fluorescent protein, a chemiluminescent protein, or any combination thereof.

26. A method for making a recombinant K2 bacteriophage in a bacterial host cell comprising
   (a) contacting a first K2 bacteriophage genome with a first sgRNA-CRISPR enzyme complex and a second sgRNA-CRISPR enzyme complex in vivo under conditions where
      (i) the first sgRNA-CRISPR enzyme complex cleaves a first protospacer sequence

```
                                       (SEQ ID NO: 13)
         5' ATGCTTGGTTAATCAATTAA 3'
``` within the first K2 bacteriophage genome; and
      (ii) the second sgRNA-CRISPR enzyme complex cleaves a second protospacer sequence

```
                                       (SEQ ID NO: 14)
         5' GACTTTGGTCAAATACCGAT 3'
``` within the first K2 bacteriophage genome to produce a cleaved first K2 bacteriophage genome;
   (b) recombining in vivo the cleaved first K2 bacteriophage genome with a heterologous nucleic acid sequence in the presence of a recombination system under conditions to produce the recombinant K2 bacteriophage genome, wherein the bacterial host cell is infected with the first K2 bacteriophage genome, and wherein the heterologous nucleic acid sequence comprises an open reading frame that encodes a bioluminescent protein, a fluorescent protein, a chemiluminescent protein, or any combination thereof.

* * * * *